United States Patent 12,048,720 (COMPOSITIONS COMPRISING BACTERIAL STRAINS) - sequence listing, part 3

SEQ ID NO: 10 - DNA, 4979951 bp, Parabacteroides distasonis (residues 3,319,969-4,979,951 of 4,979,951)
gacggcatttctttaagttattagcggcgacaggactgatcgcgggagctaataccggaaaagcaaacgctttttcaagcagcgcaaaaggtaaaatcgttattatcggtggaggagccgctggtatcagtatggctgcccgattaaaacattggcttgatgaaccggatatcaccctgattgaccccagcgatcgtcagttttatcaaccgggattcactctgatcgcctcaggtgtataccaaccggaagatgtttggaagaagcaagaggattgtatgcctagcggtataaaatggataaaggactcggtcgctgcggttgatcccgtatggaatcaagtaacgaccaaaagtaacggaaagattccgtacgactttttagtactgaccccgggattacaatgtaactgggaaaaagtagagggcattacccacgacaccttgggacaaggaaacgcaaactctatttacgatttcgaaggagcccaaaagacatggaaagctcttcaagaattcgctaaaaaaggaggcaaaggtatttataccgatacctatacaaaacataaatgtggtggcgctcccaaaaagatctgtttattatccgagcattacgcaaggaaacaagggactcgcgacaaactgcaattgaattattttaccgcatcgaaggagctatacgatattccgtatttcacgcctcgcttgctggaaatatataatgaacgtaacatacctattaacttgaatgtacgtgtaaaaggtgtagacacatccgcaaaacaagtgcattttgagaaaatagagacaaaaggcgaagaaaagatcgtaacgccgttcgtagaggattacgatttcttacacttcaccccgcctatgtccgctcccgatttcgttcgtgatgccggattaggttggacagaaggtaaattggccgcggacgcatgggtaatggtcgataaagagaccttggtacataagaaataccagaacatcgtttctctgggtgatgtagccggtatcccgaccagtaaaacatctgccgctatccgtaagcaagtacctatcgccgccaagaacctgatcgcgctcatggaaggtaaagagccgaccgagaaatacaacggttatgccgcttgcccgatcgttacggattatggacacgtgttgctttgtgagtttgactacgaaaagaaaccagacatttcattcccattctcgatgatcgatacatcaaaagagcaatggcttgcttggatcttaaaggtatatattttaaaaccgatgtatttcaacggaatgcttaacggttacgcataatatgaataaaaaaaatctatgaaataaaactccctataatttcgaatgccaaactacaaagccccgggtttcagttgtacgaaaccggggtttttgatttttaacgggtagccttttccactaaatatacgatcgacttataggatatcccactattcatcgtcaaaccaatctcgcacgtacggctattgctatatccttccgtcgccccatgcaagttcggtttcaagtaatgaagaccggaagcgtttagttccggatagaagaaaccacgatcgcccgcccaaccgcaacaagtaacttgagcgggagagaccacccggttcgcgcataagcccgccagttccaccagcttgtcttgtactcccatcttcgttgtactacaagtagagtgtaccgctaccgtaaccggcaacttagtaaagttcagacgatcacgcataaagtcatagataaactccacaggttcatataatcgtaaacgtttatccaaggtttccctcatatgcagcaagcaagggctcatgtcacacaaaataggcaagcggccgttatcgctcgcccgcaaaagagcctcattcaattcctccgccttctgcgccgcttgcttccggaaccctttactgctaaaagccatgccgcaacaaagcttacttagattctcaggataacgaatcgtaaagtccgctcttgtcaataaagcgattatttgttccgttacacttacaaaatccacatcttcataatcagctgaagctcccatcgtacgggtaatacaagacgggaaataaaccatttccatcccattctctacacccgtcagttccttgaactttgacgcgccagaaggtgtatgccgagtccaaagcgggaatttatgagcggaagccctaaacaagaaagaggcaaatctctcgaatgcgttataccccaccagctttgaaagcacatgaggcagcttaagcaaaggacgaagcatacccgttacggttcccatattcccggcgatgcctgaagcgatagcattcgccaagacaccattctctttccaccgtaactctttgatcaataaaccggtattaatgccaaccggacatgccgtagcacataggccatcggtagcgcaggtagcgttacctttatagttaaaggctttcttgagttctttatatcgcttagagtttgtttccccctgttccgccaaagccgataattccctatagatcacgatacgttgccggggtgtcaatgtcacatgccttgacggacattgtatctcacaaaaaccacactcgatgcatttatcgatcagctcattcgccaacggtatttgctttaagttctttataaacacatccgggtcccgatttaaaaggacgcccggatttaatatattttccgggtcaaagagccttttgatcttccacatcaactcataaatctcctcaccccattcatctttaacaaatggagccatatttcgtcccgtgccatgctccgctttcaagctaccgtcgtagtaaagtaccacatctacaaggctacgcataaaagaagcgtaatgatcgataccttcctgtgcgtttatatccggaaaaatcgtgaaatgaacgtttccatccaataaatgtccccacatcaccgcatttccgtatccataatccgacaagaccccacgcacttgttccaaagcctctcctaaaacctcttcccggaaagcaatatcttcaataatagataccgtcccccgtggccgtcttcccgcagcggaagtaaataaaccgtttcgtacccgccaataagtagcgtaaagcttcggatcggtcgtaaatgataccggacataaggtctgtatatctgctagccgctcctctatatcccggaattggatttgaagttcttcttccgaattagaagacgtgtcgatcagtaacgctaccgcatcctcgggtaaagaatgtaatatctccggcatccccggttcatcctctaccgcatgtaaggcgtttctatccatcaactcggcggcggacaccttgcattggcgtaacgggtctatggctctgcatgcttctatcaaagaggggaaataaatcaaggcggaagcttttaaagactcatccgggactgtctcgaaagtaaccgaagaaataaaccctaaggttccttccgagccaaccattaaatgcatgagtatatcgtatggatcagtataatccaagaaagagttcattccataaccgcaggtattcttcaactcatatttagatagaatccggtcttccatgtccggattcaacaagatctccaaacggaaattcatcaacttttccaataagcctatatgcgtttgcatgaaatccctgcgactcgctaacgaagaagtatccaaaaaggctccatccgcgaagataatttccatatcccgaatcgtattatacgagttatggataataccatagctagaaccactcgagttattcgctacgatcccacctatacgtgcggatttgatggaggcagggctaggacccagtttgcggccataaggcctcagccaccggttcgcctcttctccagttataccacaggggaatttagctaaactcccatctcctgaaatcttaacctttccataatcaggactgatttccatcaatacagaatctgtgatagtctggccggataaagaagtccccccagctttaaaggttacagatttaccagtcttctcacattcagcaagaacacgttttacatcctgctcacaactcacgatttcaactcgtttgggattcaacctgtaaatcccggcatctgttcccttcgctaatgtagttaaagcatcagcatataccttttttatcttcatagtctaatacctttatttgtctagaaacgacatttcaacaaagatatgaaacctttaagacaatcagggcatttctctaaaataacgaggagaatacccgaatactagctccggatggaaaatccagattaaatctttcaatagatattccggatgtatagggaattcctcgtaataaggaactgcacctgtattacaggtataaatccgtttttttttaaaagcgtcgaaattctcgtaaggagtatattcggagcgtaaatctttataggtcatctcagaagactgattatatttaacaagccaaatatccgcatggatcgctttatcaaacacggtctcaaatgctaagggggtacttccggcacccggtaaatccttaaacatataatcggctccggcgtcctcgataagatgagccatataactatctccggatggtacataccacgaagagccgaacttcttctccgacaaaacagtaggacgattatctatatttgcggttaagtcctttagagacaaataggcttgctctgtttctttaaatatagaatcggccatctcttcctttccgaatagcaaaccataaaagcgaatccactccgtgcgccccaaaggaaatgcctccatatagtcggctccttcgataatgggtatccctatcttctcgacaggcccataactactgttctgaaacggggaagctatcacgagttccgcaccgatctctatcattttctctatattcggagaggtagcctcacctaaatcagcgattcttccggcctgtataccctcttgtatggcaggagtatccatataacgaggctcacaaacacctataaccttattgatttcgtgcaattgatcaataatagccgcatgaacagaagtataaaccacaatatcttttaccgggaccttcacgatcgtccctttgggtaatccgccaggaaccgactttgtccggtctaccaataaatagcgttgaagcagacgagtactatcccacggatcacgaacttccaccattgtataggtatcaaagcgctgaaccgtgaaaccttgggcatattgaatactatcagaggaaagagcttccttggaagaagtttgctttccggatggcgtacatgccaccatccagaaagcgaaccctaagagaatcagtaatcgcattagatattatctttttgagcgaggactactttcatgggatttaaaccggcctcaaacttcttgaacaatttaccgtcacctccgaaacaataaatatcgccattattcttataatcagactctgcgacatagacatttccacccacggcactgattgaataaggggactgtattgaggttccatctgtaataaagctcgttcccgcagattgactctttgtatcaaatgttaaaaatgcagggctagacattccccattgcgcatagaacagaaatagcttgccatcctcataggccatctccgttgcgtttggacaattcgtaagggaagtaacctcataagtctccgtatttatcttttgtaccgtattgggtatatccgcatagttacccatagaaaccacatatacatttccttgctcatccgcctgtatccgtgtgggattcaatactacatccaacttctttatctctgtaaaagtagacagatcaaccactgataccgttttatcatacccaacctcggtactgtaatccatacctccggagtttgagacaaacaatttattagaagataccgccaattgttccggattccgtccgacctttaccttcgcctcaacctccaaggatgcggtatccaaacgagcgacatatccattataatagctaatatagacttttccaccctctgataccatataacggggctgcccctctgtcttgacttgcttaatggattttgccttcagatctgtcacttctatcgtagactctccatataccgcgatatacatcttatcgccatacacgatcatatcctgtgccgtatctcccagccccctgccattttgagccaagaaataatcggggacaacctcatccttttctatgtcgtacatatataaagaagagttgttatttcccatattgcccgaattcaagaaatataaagccatgaaagaactatccttcacaaaatcaataactcttacggaagcataaacagaagactcaccttccgcatttgcggctataactaataaatagcctatatttacgacatccgtaatagcatatgaatgtgttccaacttctacctccgcaattttcatatctttagcggttccatcagaggaaccataaatcacgtactttgttacattgtcaacagaagacggagctgtccaatttaaggttccgctaacttttaaagcttccggattctcatccgtaaaactgacattagttacagatacatttggtatgttcagtgaaggctcattgtcatcatcacagctgacaaacgagaaagacatcaatgcacacaaggcagagacacaaactaaattcttctttttcattactttacttttatagtttactaataggataaacaaatacttaaacgccaagaacggcccggcatgggataatactgaataacatcataattcacgttcgcaagatttaacaattcaccttgcaaacgcaaaccgaaatatcgaaaacgaaaatctcgatttatagaaatactctgttctatataagaatcaatcctgttccgatctatattttgcggcaatgcataacgatcaccaaccgcagtcagtatataagagacatttacccatggattttccaaggttacggaaaccgtgccagaatgacgaggtgtataaggaatctgatccttataattcttagcttccggatctgtcacatcaaccgcgtattgaaaagaataagtggaagccaaaagcaagctcattcgtaagggcaatcggaattgtgtagataaatttacatctacccctttaatatccacttcgcccatattcatcatcttccaaacatacatggtaggtaaagccacgatcttatctttcaccgtattataatatccatccgccgaaatactgaaatgccgcagccaatccccacaggaagaactccatgttacccctacattatattgggaagtttcttccggtttcaaatttgtatttcccatacggaggtaatacaagtccgtaaatgtaggaacccggaatatatctttgtaagaggcacgtatccgcaaagtactttccgagaatggccgccaagacaaacttacagccggggataaacgcctcttatcatccggtttttccccttgctccactttatcagtgatatatgttcccaataaactagcggtagccgtgaatcgactgttcttatattgcaccgctagtactgattgagaggccattcgctttggattagggccgttcacaaaattattgtccagcatagagcgagttaaatccgtagtcaacgtcgccgatacatactttataggagtatacagcaaacctacagagccataatactcattctgtgtattcaaatcgacttgttcgcccgcagcatatttatcatttatatctaaataacgagtaaaagcataattatacttagccatggcccgtagcgtaaatttctcattaagaacattcttataccccgattgcacgaaaaagttattatcccataatcgttcagaagtgttcttgttatataaattaacagaaccgggaagcccccgctccgaatcaaaatagtacgccttaaaggaaagttcgcctccccttccaaaatcgccgaatagattaccttccaaatggtaagcatggatatcgctatttctacgcttctctctcgtctccaattccccattaatcaatgtatagggatattgcccatccgcacgcacgaaatcaccatgtaaggatgcgctccaacgctttcctaatttttgatcataatgcagcacgggattaaaaagcccgaaggaacctcccttaaccttaagataagtatgaaacgatttgtctttaaacgtgggctttccggtttgtatattcaaggctcctgccgaggcatacacccttgccgtttggaagatgtcatccgattgtccgatcgataaggaaaccatctccacgttatccaacgagaaacggctgatatcgacttgcccgctttgcgcatccgtaatcgtcaccccatcgtaactgacggcggtatgcttcgctcccaagctacgtaccgagaccgttttcaatcctccgatcccccataatcctgtactgtaactcccgagaagcgtttcacggcctcggataggtcttgtactcccaagcgatcgattcccgcccggtccataatttgcaaaggcgtaccttcacgggtgaccgacggacgtaccttctccactacttccaccccggaaagctcgtgataggccgtcgtatcgatctgttgaccgaaagcgacacccaaagaaaataaccatacgctaaaaacgcacagacatcttataagatataaatctcgcataataattcttaggtttaccaacgtcttcacccgaaacgtcgcataacaaaatcatggcaggttttctggctcgtccaccctctgtcggctaccttcccgcctatccgataggcagtggcaacaagatttgccggggctccaaggacttacagctacgggtacagctccggactcgcaccggattcccttttactgattattatcggaatcgataacatctacaccttgattggccgcaaagatacatgtttactttttgattagcaacaaaaaagccccccggcgaatcacttcggcggaaggctagggagtttacacttttctaaacattactaacaacaaaatatttattctatgtataaaagaataatatcattaactgtgcggtcaacacacgcaaaaacatggtcaatggataaaccgtcgcatatccaaccgccggcgcatcatttcctgccgccatattggaataggctaacgcaggaggatcggtcgtacttcccgcaatcaatcccatcaacgtaaaataattcagtttataaaaataccttcccacacaaccgataatcagtagaggcaataacgttattataaaaccataaccgatccaagctacaccacccttattgactatcgtatcgacaaaaccttcacccgcactcaatcccacgcaggcgagaaacaacgtgattcctaattccctcaatagtaaattagaactttgcgtggtataagtaaccaatttataacgataaccgaaccggcttatcaatatcgcaacgatcaacggacctcccgctaatcctaatttcaccggttgaggaatacccggaaaactaataggaagacttcccacgataatacccaaaactataccaacaaaaatagtcaccaaattaggttcattcaagcgtttcattgaattacccagcgtctcggcaactttctccaccgccaattcactaccgaccactgtcacccggtcgcctatttgcaagaccagattaggagtagctaccaactccagccccgcacgattgatccgagtcacgttaattccatgtaaacggcgtaactgcaaagcccctaattgcttaccgttgatttcagaccgggtaaccaaaatacgccggctgataaactggctttccgccggaatccattgcttacgatccatctgtatttcttgaccgataaaagtctttatcgcctccacgtcatgctctgcggtaataacaaaaatcttatcatccccattcaataccgtgttccccgccacgatctctatccgattcgtatcgttacgtaaaatacgggaaataacaaattcacggtgttccaacaatttagatagctcacttacgctacgaccaaaaatcgccggattcttcaccaccaaagagataggtacagcctctcctcccgattccgtatccgtctcttcttccaattgttccgtctccttcgcaaaagagatacggaaaacataacggataaaaatcatcgacaagataatgccgatcacacctaacggataggcaaccgcatatcctaaagcgatcgtttcatccgagatccccgtcatatctgaataagcctgttgagcagcgcccaatcccggtgtattcgtcactgctccggataagatacctaccattgtcggtataggaatgcctgtaatataatgtataatcaaggcagtaatcacccctagaaaaacaataccgcaagcaagcatattcaacgtgatccctccctttcgaaacgaagagaaaaatccggggcctacttgcatacctaccgagtaaacaaataagatcaaaccaaactctctaaaaaaatgaacgaccgacggattcgccgtaaaaccgaaatgcccgagaaagatcccgacaaacagtaccatggtaatccctaaagagataccgaatagcttcagtttaccaagctggatccccagagcgatcacaacggataacaaaaggatagaatgccctaccccttctccccataacaattcattaatccattccatatctattcatgtatatattaatttaagataaaaaagtacctctggcgaatcacttcggcagagatacacatattgaacatttagtatcccagtttaatctggcatccattctaacaacatttactaatatattttctatttcttatgctgataatttagacaaactttcctcttccggcaaaagggttaccggccattcaaatgtcgcacgacagtgcgaacagatccttttcatacgtctttgttccttttaagatattgcttatcttttcgtactgctttcctaatccctcgagcaaaaacagcctttaatgaatggcaggtcttctgactgactcccatcttgaagccttcccggtcgctagaaccagtggcgatagtgttgtttcaagatgttcttcggagcttcacagcagcgggactgtccgggatttacacccgattcccttttaatccacatacccgaatggtatatgcggaaccgattcgggaacaaagatagcatgttttccgtatatatcatatcttttcgcttttttgtttacttttattatccaaataaaaaaatcccgggacaaaacaattgaaccgggatcttttaacctctaagctatcctcccgacaggaagaggctttgattttccttaaataataattactacaagggaatatttccatgttttttaggaggattactctggctcttatttttcgccatttccaacgcctgaatcaatttaaaacgtgtgtctctaggttgtatgacttcatctataaatccttgctcggctgcccggtaaggatttgagaatttctcggtgtattcacgaattgcttgtttcttctcctcatcgttggctttccggtataatatattcacggcaccttcagcccccatcaccgcaatctcagccatcggatatgccaagtttatatcggcaccggtaggcttacttgccattacgatataggctcccccgtaagccttccgggtaatcaacgtgattttgggaaccgtggcctccgcataagcgtagacaatttttgccccgtggcgtataattcccgcatgttcttgcgtacagcccggcaagaagcccggcacatcctcgaacgtgatcaatggaatattgaagcaatcgcagaagcgaatgaaacgtgcggccttatcagaagcatcgatatccaagactcccgctaaaaaggcaggttggttccctacgatacctatggtacggcctcccaaacgagcgaatcccactacaatattgcgagcgaaatgaggcataatctcgaaaaagtaatgattatccactatcggctctataatatccttgatgtcataagggacattaggatcttccggaatcacatgctgcaacgactcttctacccgacgcacatcgtcagcacaagctataactggagcgtcttccatattattagaaggcaggaaactcagaagttcccggatactcatcaaagtctcctcttccgtatcacacacaaaatgtgcgaccccgctttttccgctatgtacctgcgccccgcccagctcttccttatcgatcacctcgtgagtcaccgcctttacgacatccggccccgtgataaacatatgactttgctctttgaccataaaaataaaatcggtcaaagccggggaataacaagcgccccccgcacaaggccccaaaatagccgataattggggaacgactcccgaggccatcgtattttggtaaaagatagaagcataaccagccaagctattcaccccttcttgaatccgggcaccccccgagtcattcaaggcgatgatcggcgctccgttctttaaggctaattgttgcactttcacgatcttagcggcattcgtggcactcaaggtcccaccgtatgcggtaaaatcataagcgtaaacaaataccaaacgaccatcgatctttccataaccacttaccattccatcaccgggaatcttattcttatccatcccgaagtttgtacaccgatgcaccacgaatttatccagctcattgaaagtccctttatccaacagcatctcgattcgttcacgggcggtcatacgcccgcaagcatgttgtttctcaatgcgattcaatcctcctcccaacgaggcctctttattcaaagcctcaaaatctttatataattgctcgttattcatatgaatcatcttttaataggtctaaagtcataagcacttgattgttatcaacggaatctccctcggataccaatatatcttttaccacgcatgctgagcttaccttatagttactctgcatcttcatcgcctcaagtacgaccacggtatcccccgtttccaagcgatctcctttccgcacaggtattttcacgactttacccggcatcggggcgacaatcttgtcatcttgcttctcttccgcacttttacgcatacgcaaatatttcttttgggtatctacgatatccacatgataggaacggtagaacatattcacgtcataactccgatgatcttctccggagatgatctccgcgttaaatgagttcccatcgtgcaagacagaacaactgccgttctccgtcatcacgatatccacatcatacggcttcccgtcgatagaaagccggactttattcccttctttactgaccaatgtcacatcggccacacgatttccgatatgtatttccataaccaatacccgttaaatccgtaagacacctttttgtaaaccaaactcccgccaacggctgataggacgtgtatccaccaattgggtagaagtattttcctctaaattcatcaaataatccatataagcggcgatcatggcgatattctcgatttcctcgttattaccgttagaccgttgtagcatccgggcattcttagcgataaataatgtattatattcccctttcacgaaatcaggattatgcatgatacgtttcaaataactgaggttcgtctttaagcccgtgattttatattcatatagaacccggcgcatacgctcgatcgcatacgcacgtgtcgttgcccatacgattaatttaccgatcatagggtcataatagaccggaatctcatacccttcatatacatagctatcgatacgtaccccgataccattcggttccgttaattgccggataatacccggggaaggcatgaaattattttccgtatcctccgcacagatccggcactcgatggcatgtcctcgttggaaaagatcttcttgacgaagatgcaaaacctcattattggcgatacggatttgttcctttaccaaatccacccctaccacttcttccgtgataggatgctctacttgtagccgggtattcatttccaaaaaataaaaatggcggtccttatctacaaggaactctatcgttcccgctccggaataatgaaccgctttagccgcagccacagccttttcccccatttctttacgtaagtccgctgttaggaatggagacgggctttcctctactattttctggttacgacgttgaaccgaacattcccggtcaaatagatgaatgacattaccatggttatctcccaatatctggaattctatatgatgcggctcctctacgaatttctctatatataccgtatcatcaccaaatgaggacaacgattctgaacgagccgtatgataagcctcgacaacctcgcccttctcatgtatcaggcgcatcccttttcctccacctcccatagaagctttcagcataacagggaaaccaatttcttcgcaaacccgaagcgcttcttccgcactttgcaacggttgctccgtaccgggaaccacaggaacctctgcggcgatcatgcgtttgcgtgcggcgatcttatctcccatcgcttccatcgtctccgctgacgggccgataaatatcaatccttcttgcttacaacggcgtgcgaagtccgcgttctccgacaagaaaccataaccgggatgtatcgcatcggcatggtgccgtttcgccgcagcgatcagattgtctatattcaaataactttccttggaagccgccgggcctatcaaggctgcctcatccgcatacattacatgccgagcggtacgatcggtctccgaatatacggcaacagtgcgaatccccatctccttacatgagcgcatcacacggatagcgatctcacctcgattcgcaacaagcactttacggatcatgtcgccacgaggacataaattctccataaatcattaactattgattcttattcttttcgtactgctttcctaatccctcgagcaaaaacagcctttaatgaatggcaggtcttctgactgactcccatcttgaggccttcccggtcgctagaaccagtggcgatagtgttgtttcaagatgttcttcggagcttcacagcagcgggactgtccgggattcacacccgattcccttttaatccacatacccgaatggtatatgcggaaccgattcgggggcaaagatagtattttttatttaactatccacttcagccaggccggaatatacggaatacacggatcccaagtaaaattccgtacaataagctcacaagagaagcttatgcataaagcattaaaaatcaacattaaaaaaacaggataatctttctgcgaaaacacatacatgtttttgaaaaaagtcgtacgtgttttctggaaaggtcgtacgtgttttcctgaatccttccaccgaaaacaatagcgcatgctaaaatttacaagaagctccacttaaatgagatgttaaatgaaaaagccttactttttgtagagtcaacaggcaagtacagtttttatacatttcgtttgttcgtgttctcagctattttgtgtaactttgcgtatgcttgaaggcatatcaatttgaagctgcctattcttgcttgcgttaccttgtcgtaataattggctcaaataaagaataagactctacaatgagatgaattgaacacatgaaaactgaatatcaaaaatgtatggatgaggagcctttcgacggctcatcgcccgaaataacggaaatgactgtccgtaacaaaaggctactacaccaactcagagaaacggattatgccgacaatgaggcaaagcagcgcatctatcggcagatgttcggaagtatcggcaaggatgtttacatcgacatagacttccgatgcgagtatgggaaaaacatctatttcgggaacaaggtgatcgtgaacatgaactgtacgttcctcgataataacaatatcattatcggtaacaacgtgatgatagcccccgatgtgaaaatatataccgcaactcattccgttcaccttgcggaaaggatgccggaaaggacacatcccggagcgtccatctgcgacacaattgcccgacctgtccttatagaaaatggtgtatggataggaggcggctctacaatccttccgggtgtgaccatcggtaaaaactctgtcatcggagcaggcagtgttgtcgtgaaagatattcctgccaattccatagctgtcggcaatccttgccgtgtaattaaaaatatcgaagataatgattaaaaacctcatttttgattttggcaaggtcctcgtaaatcacgatttgcaacccttgcttgaacgacatttcggggatgatgaagtgtcactaatcggttttcacaaaattctatcagatccgaaatttataaacatgtgcgaccgtggaataatcccgtttgataaaatgattgacggagcgataaaaaggtatcctgaatatagtgatgccttcacgtttttcaaagataattatctagaagagataacaggagagattgaaggtatgcgtgtacttctaaaaaagttaaagcaatctggattcaaactatatgggttgacgaactggagcgacacaatctaccgggtcatggagaaattcgacatattccggttacttgacggtatggtaatatcatgtgaggaacacttcatcaagccagaaaaggaaatttatcttcgccttcgtgacaaatatggccttaaaccgtcggaatgtttgtttacggatgacagaatggtgaatgtgttgggtgcaaaggcgattggaatggaagctgtattgttcacaacacccaaagaatatatttttgaaatagagcgaatttgcggtatcaaaattgaacaatgatgaataccagaaattgcaacagccggagatgcgtttagagaatagcgaatatcgcaccattgattaacgacaaataaaacaaagaagaatatgggtatcggaaaatggataggcggtgtcttggggtttatggcattcggaccactgggcgctttagccggtattatattaggctctttctttgaggaagaggcaaacatgacgggacagcccttcggtggcagaaccaattacgatgatcaatatacacgaagagacccatacgccggggagcgtaacagtttccttttctccatgttggtaatggcctcctatatcatccgtgccgatgggaaaatcatgcacagcgagatggaatatgtccgtcaattcctccgaaggaacttcggcgagatcgccgtaggccaaggtgaagagatattgctaaagcttttcgaccaagccaaacgcatggagcaagagaatagcataggattcaagaataccatccgggaatgcggaacccagatcgcatacaacctaagttatgaggagcggctgcaactgctggcgttcctcgccgagatcgctaagagcgacggtaatgtttgcgccaccgagatcaacgctttaaaagaggtagccatagcgatgggaatgtctgaaaaggaagttgaatccatgttaaatcttcaggaaaactccctagataacgcctataaagtattagagatagaacccacggctacggacgatgaggtgcgtgccgcttaccgccgcatggctatcaaacatcatccggacaaagtagccaaccttggtgaagatatccgcaaggccgccaatgagaaactccaaaagatcaatgaggctaaggagcgtatctataaagcgagaggcatgaagtaaataagaaaatggaaatattttctcaatgtctgtattatttaattaaaaagacctacctttgcccacgattttagtaaccaagctatcacatagtttggtgagagggaatccggtgtgaatccggagctgttcctgcagctgtaatcctcattaagttggttagaagttcaaaagccactgttcttgaattggaatgggaaggtttctaaccagaggagagccagaatacctgctaaagtcttacaataacatcaagcttccaggatagaagtatgtgtcatacaaaaaacgattcaatttattttttgagacataaccagatagaggcttgttgttttatttcgtgtataaataaaacactatatgaggcttttagcattcgctattctggtggcatgcgtacaatccgtatgcgcccaaagcatattgaaagatccgaaggaactttccgtgctattgaacgaggtcgtggtcaccggtacgggtaccgaacactatctgaaagacgcccctgtgcaaacagaggtaatcaccggcaaagcccttgacagttaccaaggacgtagtatgcaagatattctggaagggctgaacgcttccatcaccttcaatccgagcgacatgggtagtggcatccagatgaacggattaggcaacgattacatcttgatccttatcaatggcaaacggatcaacggagataccggcggacaaaacgacttgagtattatcaaccccgccaatatcgaacgtatcgagatcgtaaaaggtgccgcctcttccctgtatggctcggacgctatcgccggtgtcatcaatattatcacgaaaaagaaccgggataaagtgagcctatcgaatacgactcgtgtcggatcatatggagatatattggaaagcgtacaaatcggctttgggcataagagagtgaattccaacacctcacttagtacgacccatacggacggctggcgaaatacgacccaagaatgggaccatcacgaggtaatgaatggaaccgtgacacgaaccgtaaaccgatccacgaactttacgttaagggagaacttaacctacaaagtgaacgaccggctgagcctttcggccgatggctctttttaccagaaatggaattatcgtccgcacggcgcattcaagtattatacctatgatcaattctaccggaacttcgatgtagccggaggagctaaatacgcattgggagggcagaacttcctttcggtagatctaacgtatggtaactatagctatttctataattaccatcataaagatgtcacgaacttcttcgatccgaagacggatttacgtatcactcgttatcccggagaacatattctggaaacctctcaacaacgtttcctaggacaagccaaaagcgtattccacctcggtgaaaacaatatcctaagcgccgggctcgaatatcaatacgatcatttgaaatcccccggcgtatcgagaacgggaaagcctccgtatttacggcttccgcttatgtacaagacgaatggaacccgacggatcggttgaatgtgacggtaggtgggcgcttcgtcgtgcaccaagagttcggggctacgtttacccctaaagtctccgccatgtacaaactaggcgacttcaatatccgagccacatactcaaatggatttaaggctcctaccttaaaggagttgcacgatgattatatcacgcagatcggcggcggcccgtggaaacattattatggtaataaggatttaaaaccgcaaaagtccaattattattcggcgagcgtagaatatcatgcgtcgaacctgcagatcacggtaacaggattctacaaccgtatcaagaacatgatcgccttgaccgagatcccgacaagcgccgaagaccgattggatgagatcgaggccagcatgcaacacaagaacttatccaaagcccgctctttcggaggagatatatcgctcacctatcaaatcctatcttccttggctattggtggaggctatagctatacggatgccaaagcgcaatatacggatgatccagccgacccgaattatatgctctacaccccgatcaacggaacctcattccataatgccaattggaaactggcatggaaccatgcgtggaaaaagtataaattggatgtcactttgttcggccgataccaatctacccgcttttatatcacggacggtgatggaaaaagttatcagctatggcgattgaatacccgtcataacgtattgaaaaagaaaaaatggaacctagatatcaatgtcggtatcgataatatcttcgattatgtggatcgtaccccgttcggacgccatcgtggaactacgtctcccggacggacttggtacgcctcttttatcgtgaaatttcagaataaacataaactataaacaatcttaaaagttaaatgcgatgaacaaatttaagtaccttttgcttgcggcgagtctatttgcctcaaacgcagtttttacctcctgtgatgatggagacgacgacaataccgcaaacccggcggaagaagtcgtaaaggcaagtaagaaacatgacacggcgatcttgttgtgtacattcggtagcacattcaaggagtctatcaagacatacgacgctacactagccgatttccaaaacgcatttcccgatgcggacatctatttgtcatttacctcccgtacttgtgtgaatcgtgtagaagcagagacaggtatcgcacgttaccaaccggacctttggttacaagccctaggaaatgccggttacaagaaggttgcggtacagtccttacacatcatcccgggtgaggaatacctaagcttgatgaatacggacgtgaagaagaaattcatgatcgagtctttcccgagtgttcaagtcgtaaaaagcccttgtttggtgtacaacgaagaggatgtggaagccgtagcaaaagtcctatacagccactacagtgataaattggctgataacaagaacgtccttttattaatgggacatggtaacccggataaaaactataacgcaaatacgaaatacacggaaacagaagaggctatgcaagccttggccgctaacaagaatgtattcgtaggtaccgttgattacggagatatgttgttctggccggaagaaggcgaaccaaatgaggaatgtgtctattccaaacttaccaaataccgcgaggatcataacttaaaaccggaagagatcacgatctccttagctccgttcatgtctatcgccggagaccatgcgcataatgacctttggggtattgaggagggtgatgatttcagcgctgccgctcctaacgccgacgcttgctggagactaaaacttttgaagatgggcttcaagatcgacacggaagaaagccataacggaagtttagagaactgtaagatcataggcttaggcgattacgacgctgttcgtcagatctgggtgaaccatctaaaagcattatataatgatgcggaggcttgggaaaccggagaagactaccagtaaataattgagaattgagaattgaaaattagggagtacttactgaaccaattttcaattctcaattttcaattgttcagtgtgtatataatttctttcgatcaaaaatcgtcgcccgtttatatttcatggcgaaacggatgtgatcgataaataaagaccggatcgccggattctcacctagaggctttaaataaatatccacatcgaaaccctgttgacgtagccctttctgccagaaatccgtaaccgtattttccgtacctcgaatcagtacgaacataaaaggaatcaactccacacgcttatgaccggcttggcgcatttgctcacctacatcctcgatcgtagggaaaccctcacgggttccggtataataatctttcattcctttggtctggaacatataccccaatttcgcgtaagccgagttactggcatgataagttccgtgcgccaccaataacttagccccatttttagtcactccagaaggtgaggaaaccgctttcatcaccgcctcataatcggtatcatcatataacaagggattacctacacgcaaatccttaaacaaaccttttcgctgttccgcctctttgcggatcgcttccatctccacaccctctataatgatagtcggttggattatcacatgggtaaacccttgatcacgcaactctaccaaggcgtccgccggcaactgaacccaaacaccttgcgccctcaaccgactcactacgctacgggcgctataagcctgccggacttccacgtctgggaaagcctccttgacacgcttgttcatcacatcgagtacttgggtacgagcttccgggtaagcactcccgaaatgtaccatcaagatcgctaacttatctcccttttccatgctctcccggatatcggaagcgtaaaactcccgcccgggtttcgcccataatgaacaggcgagcccgagcaggagtgaacaaacaaacatggatcgtaaaaatcccctatacattattatattagttaatagttgacatgtgacagtttactgcttgaaacggaccagaaggctgacgtaataggtacggcccggggtcaatgtagcgtaattgtaattaaagggacgatcatctacataatcaaaaaggttctcgatacctactcccggttccaacaagaaatcgccggctctaaacgtatggctcgtattgagattccacaaggaatatttcggtgcgtatccataagaagtagaataacgttccccttggatacgtccgttaaaattcacgttcagcttatacttattccaagtatgagaccacatagccgctaccgtaccactatgcttaacggtcttatccaaaggctcatcctcatatacgttttttccatccatgaaactatagccaccattcaaggtaaagcccgctcccagataactattgaaggccacgttaatacctttgatcttcgctttatcgatattcgcacgcatctgtatctcatcatagtacgtaccatgggcggtgttataagcatcccgttccgccgtatccaacatcttatagttaatcatgctacgtacgttattcataaaagcggacacggacaaagagaaataccgcatcgtatattctgcgctcaacgtaaaattgtcgctcttctccgggtccagatccggattaccgatcgtaaggcgagtcgctccggacgctttcttctccgattccgtatacaactctttcaattcaggtgtacggaaaccagccgcatacgatccgcggaaattaaaaccgcctaccttatacagcaaagccacgttaggagtcgcataactcttaaaattctcatggtaaatatagcgcaaacccgcgtacgcttggaaatgctcattgatattgatctcgtcttgagcataaagcgcagtcgtgtacatacttttacccgctatgttatccgtctcgctactcagtaactctttaatgaactccgcaccagccgaaagcttattatatttgcccaaacgaaagattcccttgacattcaagttatggtaatgaatccgtttcgtcatatcactctctccgcttttctttccatcaaagaaatccttatacgtactatgattgtccgacagataatcagcgttcaaataagagttcttattaatcatgtattgagcgcccgccccataagtgaacgtctcttttctcatatcatagttggtcgtattcactttatccattggcatcggacgatcgctggaacgtccgaagaaagtaccacgcacataaaaagacaaacgatccgtagcgtcgtacgtgaaacgttggttgatcacgttccggtgaaatccctcggaagcttgcttattggtaggaaccaactcgcctttactctccgtatagggatttaattgccaaccatcggcccgttgatattgataagaagtatatgaaccgaacttccctacattcacgtccgcattgaccgactgcaagaattggttcttgctaccataacggctattgctcgtcacgttcaccttattacgggaatcatccgtgatgatattgataacgccggcgatcgcatcgctaccatacaaagcggaagcggccccgttcaatatctctacccgctttacgttagacatatcgatacgggaataggtatcatcgccggccaaacgcttaccgttttccaagataaccacgtatttctctgtcaatccgttcatattcatcgtagccccctgtccgttttccataaatacgatactcggattcagcttggtcatcgcatcttggaaattggttacgctcgcctctttcaagtcttttcccgtaagcactttcacgggaataggagaattactcatgcggcgatgcgaaccggtaccggttaccaccacttgatcgatattcacatacttttctttcagcttaataacgacatctttttccgagtgatccgtttgatacacgccctgttcatagccaaggtaagtcacacgaatacgatgtctaccatcgggaaggttcagctcaaattttccgccggcatccgtggttgtaccattcaaggattccgacacgcggatattcgcgcccgggattggttcattactttcatccacgaccttaccctgtaaacgtacctgcgcaaatgatacgtttatcgcacaacttacagctaaagccgcgcacaaacactttcttttcataaacgatttgttattatgtatatttccgctttcctgaccccgagaaaaacagcaataaaaacgcttggcaggtttcctgacttacttcgtagagaacgaccttcccgtcttttacagacagtggtatgagaaatgttttctactttacaaaagcttacagtagcgggcactgctccggattcacaccggattccctctttatgacgaaaccggatggtttttacgtcatcaccaaaacgggggcaaaagtatgaattattttatataaacaaaaatatatcccggcttatgttctttaatagctttacaaagagaagcttataacacatcacatcgccaaaaaggaaaacaaaagcaatcatgcaagatacaaagttttccaaaactttttacaactcactgtaaattaatatattaacataatttaatcagcaaaaagttttccaaaaagaaaatcatatagagtaataagatacctttgcacgcataatcaatcacaaattaatcgacatcatgatacagacagttgttaaacgggacgggcgtatcgttggcttcaacgaggagaagatagtaaccgctatccgtaaagccatgttgcatacagacaagggagaagatatgcaactgattcgccaaatcacagaccatatctcattcaagggagaacctcaaatgaccgtagaggcgattcaagatgccgtggaactggaattgatggccagtagccggaaggacgtagcgcagaaatatatcgcttaccgaaatcagcgaagcgtagcccgcaaggcgaaaacacgggatatgttcttggagattatcaatatcaaatccaacgacatcacccgtgagaacgcgaatatgaacgccgatacacccgccggcatgatgatgaaattctccagcgagaccaccaagccgtttgtcgatgactatttattgagcgaagaggtcaaggaagccgtatctaacaactacctccatattcatgataaagattattatccgactaaaagcttgacctgcgtacaacacccgttggatcgcatcctgaaatacgggttctccgccggtcatggcgaatcacgtccggctaaacgaatcgaaaccgcaagcatccttggctgtatctctctagagaccgcccaaaacgagatgcatggcggacaggcgataccggcgttcgacttctacctagctccttacgtacgtaatagctttatcgaggaagtaaagaccttagaggatttatacggacaggatttctcccacttatataataagcctatcgacgattaccagacacagaccttggatggattaagcggtgatagacgcgtcatacaacatgccatcaaccgcacggtaagccgtgtacaccaatcgatggaggcttttatccataatatgaacacgatccattcccgtggaggcaaccaagtggtattcagctccatcaattatgggaccgacacctcggcggaaggtcgttgcatcatccgggagttattaaaaagtacttacagaggcgtaggtaacggcgagaccgctatcttcccgatccagatatggaaaaagaaacgaggcgtaagctatctgccggaagaccgtaactacgatctttaccaattggcctgcaaggtcaccgcccgtcgtttcttcccgaacttcttgaatctcgacgcgaccttcaaccaaagcgaggattggaaagaggacgatcctcagcgctatatccacgaggtagcgaccatgggatgccgtacccgtgtattcgagaatcgtttcggaccaaaaacttctatcggacgaggtaatatatccttctcgacgatcaatatcgtacgattggctatcgagtgcatgcaagtggagaataaggaagagcgtatcgccctatttttcgctaaactggatcatatgctggaacttacggctcgtcagttgcatgagcgtatggagttccagaaaaccgcttacgcgaagcaattcccgttgttgatgtcttccttgtggttaggctcggaaaaattgaagcctaacgattcgattgcctccgttatcaaccaaggcaccttgggcatcggctttatcggactggccgaatgcttggtagcccttaccgggaagcatcatggcgaagatgaggattcgcaagccttaggcataaggatcgttacgtatatccgggatcgtgccaaccaattctcggagcaataccaacacaattatagcgtactggcaactccggcagaaggtttgtccggcaagttcacaggaaaagatcgtaagaagttcggatcgctccccggtatcacggatcgggattattatacgaactctaatcacgtcccggtatattataagtgcagtgcccgtcataaagccgaagtggaagctccttatcatgatttgactcgtggcggccatatcttttacgtagagatggatggcgacgctacgcataaccccgaagcgatcatgcgtgtcgtggatatgatggataaatacaatatcggatacggttccgtaaaccataatcgtaaccgttgtctggattgtggctacgagaactccaccccgaatctggaagcctgcccgaaatgcggcagcaaacacttggacaaacttcaacgcatcaccggttacttggtaggaaccaccgaccgttggaacaacgccaagctatccgagttgaacgaccgtgtcacccacaactaattttcaattgtcaattttcaattttcaattaccatgttgtctatcatagatatcatcgaagataccaccgtagacggtccgggattccggaccgccatctatgcggcgggttgcccgaacaaatgcccgggttgccacaaccccgaatcatgggacatccataaagggaagaaagtaagaacggaagagatcgtggagaaagtgctggctgacgagttcgccaacgtcaccttcagcggaggagatcccatgttccagccggaaggcttcaccgaggtagccaaggcgatcaaggaaaaaagccaaaagacgatctggtgctacacgggatataaattcgaggacctgataaagaacccggcacaagccgccttattatcctatatcgacgtattggtagatggccgctacaaacaaacccttcgggatgagagccttttattccggggaagcagcaaccaacggttaattgacgtacaagcttctttaaataaaaaggaaatcgtaaaatacaagtacgatccttttatttaaggcttttaaggcacacacatgcataaaatcttgtacggaataagaaataaacatccgttctcttatatataaagagaattgcatcagcatctattcctcaattttcaacgtggtctgtacaaaccacggcgtggtttataaaatccacggcgtgatccgtacagaccacggcgtgatttatagaatagaagcgcattcaacaaagaatatataagtatccggataattattcttactgaagcgagacggatattagcatgatttcatacctttgcatccgaattggttccgtacgctcgttcgggcatacggattaaaagggaatccggtgagaatccggtacagtcccgctgctgtgaaactcctttaacattctaatactactttcgccactggcctagtaagccgggaaggcattagaatgggagtcagtcagaagacctgccattcatttaagattcatatcctcgtgggttagggtatagagaacacatatataagaacaaaaagaagatgatgacagacaaggaagtattgttattacggcgcaaattggatcttttgctccgtacgggaaaattgttgatggaaagtgccgccgatacgaaccgtatcgagcgtaacatgaagcgggtggccgcctttatggggattcccgaggagaaattgcatatcgatatccgatggaccatgattatggtgaacgtaagcgatgagcgaaactcattctccaaattccagaaatgcgagaaacatggtattaacatgacaacgatatcacaggtcagcaagctctcatggcgggcgatcgagcaagattattctttggataaatatgaggaagaattggaaaagatagttcgccaacctcggaattataccccttatatcgtagcggtcggagcaggattcgcttgtggaggtttctgtaagttatttggaggagactggatcgcgttcttgttaacctcgatctgtacttttatcggtttcagggtgcgtgcccgttgtgtagaggctggccttaacgcctacatggggatcgctcttgccgcctttatttgtacttgcctagcatatgcctcatcttttctgggaatatccgatactccgtatctcccgttactggcttgtgccctattcatcgtaccgggcgtacctttgattaattttgtagacgatatgatcgataatcacttgctggtcggtattacccgtgccgcaaacacggtgatgatggtagcggcaatgactttcggtatcgctttcgccttgcgcctgctcgtgatgaacgacgtatcgatcgaccataaattcagcgaactaagcatggtcccgcatgatccgtattacgtatatgcgatagcggctgccatatccgccgttggtttctctatgatattcaatatccaacgccgtttattatgggtggttgctttaggcggtattatcgccgtatgcatccggaacttcgtgaacttcgagctgggctatggtcccgtgatcggctcgtttatgggaagtttcgttgtcagcctgatcgcagtgaaagcggttcattggttccatgtaccgaaccatgtattgacgatcccttctgttatcccaatgatcccgggagtattgatgtatcgctcgttattaggttttatcaaccttcacggggtgatcggcgaggttacgaacgccttctccaatggtattaactccgccctcatcatcctttgtatctctttaggcgtagccgtccccaatatcttcgcccgtcgttacatcgccaaagaccgccaacgttatctgcaagaggaattggagaaacgcaggcaaagaggtaagtttatcgagtggtgatttaagctggccattcgtgggtattcccgaccgtcaaaatacatatttataggtattgccgagactaataagatatcggatatttgctttcgttatcaaactataaaaacaaatagaaatgaagactataggaatattctacggctcgtctacaggaacgacggaagggatcgcgaaacgtatcgcagagaagctgggtgtggaagacaaagatattcatgacgtatctaacgcttctcccgctgatgtagcgccttatgaaatcttgttattgggctgttccacttggggcgccggagatttgcaagatgattgggatagttatctagggaaactgaaaaagctggacttaagtgagaaaaccgtcgcattattcggttgcggagactcagcctcttttagcgacactttctgtgacgccatcggtacgatctattccgacctgcgaaatacaggttgcaaattcattggcgctgtagatgcttcgggatattcatttgacagttccaccgcctgcataaacggtatgttcgtcggacttcctttggatgaaatgaatgaagacgatcaaacagaagggcggatcgaccagtggttggcatctataaggaaagaaggaattgaatagacgcacacttttacatacataactgtttaaccttaatattacaacgtttgcgtattcaacttgattggtttagatttatgaagaggtatgtgggtcaaacatacctctttcttttcatctcagtttcctgaattgtttctttatccaaaaataatagccggttatcgcgaagatcgtccccaacaaggaaactaagcaagtcaatatacgggtagtcattccccccacgagccgacgtgtacggaataaatccatcctcttatcttccccgattttgggagatctttatataattggacttccgtaatctcacccgtagcaggatcaaaggagtaacggtcgcttcctctcgtatttccataacgggccgtagaaaccgtagcggagccatcttggatcgtgattgagttaaagtccggataatggcttttcaatgccgataacacctcagcccattgtgtgtaatccgtctttttcttcgcgggtttcttcgcgccggaagaagctggagcatgatgcgcttgaggcgggtttgcactaataccgaagacactataaaaggcatttcgataccaaccaaacgaccatgttaatccggttaacgctaagataagcaggagcaatgccgcatagaatcccccggagacatgtaaatcatagaagaaacggaaccaaccagccttggtctttactttcaaccggtttctcaatacttttttattacggggataccaaattacgattccacttataataataatcgccaagaccaaagtcgcatagccaactattgattttccccaagaaaaacttccatcccgtttatactcatcaagtaaccaacgatgaagacgcatcattttcaggaaaaaaccttgtccgtcatccatcccggtcacctccccggtgtagggatcaataaaacccgcggcctttttccccggtaatatcagttgataagttcgtctcgggtcagacgatacccgaataccgtttattcgaaccgaatcgggtaattgttggcgcgccgattctatcaaggtggcaggcgagagaggttccccttttacttcctttacaaaataacgggaagggtagcctaattctaatatctctgtctcaaagacgagaatcgccccggtcaggcagacaatcgcaataataatgccaaaaggtatcgatagccataaatgtactttcgcaaagaattttctcattttccgaataattgtttaatcccgtcatatatacccggaaccgctaccgttccatggttctcgtcgggaaatgatttactaaagaaacgcaggttctccgcttgcggtaaaagctccgaaagaagataactcactttgtcaagatgaatgtccacccggtccgtcctttttttagacgcgacaccgatatacaggcttttccctttaaaatcccggcctgcaaccaaagcctccgcctcccggaccaaccgcccctgatcccaccacaaactagggtcgaccgctagataggtatcaaataattccgtatgacgaagaaacatattcaaggtgaaaagccccgcatacgaatgaccgataagcatattccagccgttcgtgcgataggcactatcgatagcagggcgaagttcttccgtaagaaacttactgaaagcctcacttccccctccttgcggaatcgcatctatggagattttaccatcccgtccggcggctgaagcggtaggcgtaaaatcacgtgtccgatccgtatttaataccccgacaataatacagggaggtagatatttacctctaccggatgccaacgttttccttatgcctaccagcgaatgaaagaaagaatctccatctagcaggtaaacaaccggatagcgttgtttcgtatccatattataatgctccggcaggtgtatccaataactccggtcttcttgcaatacggtagagtacaaaaccagttcctttcctatacaaatatcctcctggctccgcagggttagcgggagcaggaggaatattaaaagaatgtgagtccgactcatacttgcttattattcttgagcggcagtcaatttacctacaccactgatttgctctgcctcaacggtaagaccttttgtagcggtagctgtcttcggatcgatacgatacacggcaggttgacttccatcggtagtcgtaaccgccatataagcgataccatcctccgagaacggagtattgccaaatccggaaataacatccgtggaaggcagccccttcacgtaagtaagactcttatcctctcctttataaatagccaactctttcgcggcgaatccggattcagtcaacggacgatcatacatcaacaacaagaaataatcttccgtgatatgccaacaacgcaagaatgccttaccacccgtctgtgcctccaaattacaataataatcaggatcaaacccctccgcgttagccttaatacgaactacaccggccggcaaagtcgttttctgtacctccgcggtcatcgtcttggcatagctgggcgagaacacatacacatcgccgttgtctgccgtccaaatggtctggtagtattgagaacggttacgtccgcaagcataactgatcttatccgtctttatcagtttcgggttctcgaatttctcgttcgcataaatagcgacccaagcctcgttcggatattgcgtccattgcaattcccctttttcgtaagcgccactaccgcttcctccggattcagtctttaccagctccgggtatttaacatatttacctccctccgctttcacgccgtacttactcaatcccatcgggatagccgcggaatagatccggccgttcgcttggagaatacccgctaacgtaacaaactcgccatttcccaaataattctccgacaagatcgtattcgtgtttgtcgtaaacgtctctttggccacatccagataagagagcaagaaacctttaggcagataaccattctcgtccgcatattcctcacccagatcaccggtagaagatgtaatgatatagtcaccgtagataccataagaagtaaaccgcttgatctcgtaagtattatcacgctccttaaccttgccttccgtattcagtacgtatgaagaagtaacaccggcatttccttgattgtaaaccaaacgatacaaatatttatccttatagaagatccattgcgtaccgctttccgtagtgagtccgttgtttttagcggagatagagccatcacccagcgtatcggctgtcaacaagtaattcgcgtcaccgacagaagcggcaactacatagctcgaaaccacctccgaggtcgatcctccgccatttccattcccgttgcctccgttatccgggtttacaggatcgtcgtcactacaagaagtaaatactcccccaaccaataacgcggcggcaagacctgtcattaaataattcttcttcatgttgttttaatctattatgttttgaattaattattgataaataaaagatagtcacactttaaattaattaccgaaataaaccctcaccttaccatagaaagccctgccagccttctgcaagctgaagttatcgtataatttctcgttcgtgagattcctgcactcgaaagagatattgtaacgcccgttctgtataccataagagagtgtcaggttatgcgagaattgagttggtaccacaaattcggattcactgcctactgcctccgaatacagcgggaaactatgcatatataaattatcgtaagtgacacttagcgtattgcctttcttccacaaattgcgccagtagaaggtcacatccgagttggcaaactgataaggaagattcggcatacgtgcgccatatgtcaagctctcttggttcgtcccgctggtaaccgtcttcacgttatccctcacattcatctgcgtaaagtttcctcctacgcttacccagttagcgaaaccgtagcgaaccgagatattgtaacccttggtctctacacgaccatgattcacataggtagcgccatatttaccgccgctcaaatccgatatattccgttggatataatctttcgtattccggtagatcaatccgccttccacatatacggaatgcttaccgaatgtctcgttgtagcttaaattcagattcacattatcgctgttctccggtttcaaggaaatatcgccggtctcaaggtcctcatcgccaaacatctcctcattggtcggcagacgataggctttctcataggataatttcgcttgcaagcttttcaagataaagtaagttcccgcagccccatatcccatcgcgcttaccgaattggtcgtacgtatatagtcatcttgagccgaggaagtagcgacaggccctgcgataaactggttgtaatatttaccgaacacagacaagttccaatgttccgtcggcatcaagcgatacgaaagaccgctgatatttttacgggtttccttcgggatagcgttcgcttccgagtcctcgttcaaaagagactgattcgaacgccggaacgcgttgatcacgtgattgaacgtgaatgtatgtgccttaccgatacggtagttagccgttaaggttccgttccagttattattatccgaccgggtgttctgataagattgctcaccgggcatccggagcggacgcatctcgccacgccaattatattcataggaagaggtatctacattgttcgtcatgttcttattataattcgccgtcaataccaaatccaagcccctaacgaagaaatcacgcttgcgatagtccaacgacggcatgatcgagtatcccttccgatatttgccgccaaacaccacttcttggcgtacgcccgtctgtatatctttatacatatgtgaataggtaaacccgaacatcaaacgatccgcccatttcttatccacgaaaccgattttcccgataacggcctcgttatgatacgtatcatgaaaacgcttcacatgctcgatctttttcttattgatcgctccggtcgtaaagtccttcaccggagtatccacatagtaattattatccgaataattctgaaaaacgttgatctcatacgtgagtccgctccggaaagtttgtccgaagttcacataagatttatgcgtattgaaagacccgtatgaataagaagcatccaagaaccatttgtcccggttcttcttggtgatgatattgataacacctccgatagcgtctgttccgaaacccaccggtaccacacccttatagacctctatacgctcggcataattcaccggaatgttattcagtccgaaagaactgccgacaccttcttgcggaaccccatcgataaagatcttgatatgcttgccggtaaatccatccatcatcagttgcatatccgagccgacaccgccggactcccggatcttcattccgggcgcttgagccaaggcttcactcaagttctgggttgaattttgcaaggctttcgtatcgagggccacggcattgaacgcagaacgcttgagccgggtcacgccattagaaacgacaaccacctcatccaactccgtagcttgagggctgattaccacattcatctttgtccgttccccacgcatcagtttcacgggtttctctaccgtcttatatccgatagccgatactactaatgtatattctcccgcgggagcttgaagatgatagataccttcctcattcgtagtcccgccgtaattcgtaccttttagataaacggtagcgaaatccacggttgttttttccgtggacaggactttgcccgatatcattgttttatgttgagaaaaagccgagatggaaataagcaacagtaaaaaggagaggaaaagccctctgattttcttcatcatcatttaatcaattatgttatttaaaacgttgcaaagttacgatcagagactaccgccccacaatacctaagaatgggtaaaatcacattaaaaatctacggaggtataccaaacaatccccttattcaggtaattggatgtatggagtaagttcgtaaaattgagttatgtcaaattttaaatctatttaaacccaatcgtaggtttttgaggtactttttcttaataaacttcaaaaaggttaactatatttgcgagaaacagatgtttaattttaattctttatcaccatgacagacagaagaacatttttgagaaacatttcattacttactttagggggcatagccagccaaaaagtaatggcttcaaatcccaccagatccatacccgccacggatgcggtatcctcggcaaccgccgggaaaaagatgggattgcaaacctattcgctcggacaggagttactgcaagatatgcctaacgggttgaaccgattggcaaaagcaggatataccgatctggagattttcggatatagggaagacactggtaaattcggtgattataatcctaaaaatacgacattcatcgcctccaaggattataagaaaatggtggatgatgccggtttgagaatcagcagctcacacttgaccccttctcttcgtgagtacacgaaagagaatatgcccaaattcgacgagttctggaaaaaggcaaccgatatccatgccgagctaggtgttagttgtatggtacaaccgagtttaccccgtatcgaaaacgaggatgacgccaaagtagtatcagagatcttcaaccgtgccggagagatcacgaagaaagccggaatcctatggggttaccataatcatagcaatgagttcaaacgggtattgaaagccggagagaaaccggaacagaacccgaatccgtgggcaccacctaagggtacttatatcgaggagttattcctgaaaaataccgatccggataaggttatgttcgagttggatgtatattgggccgttatgggacagcaagatcccgtggaatggatggagaattatccgaatcgttttaagttattgcacatcaaggatcgttggatcatcggtgattccggtatgatgaatttcccgaatatattcaagaaagcgtacgagatcggtatcctcggctactacgtggaactggaaggcgacaagaaaggccgtacccagttcgagggcgtagagaagagcgccgcctatttgcaagccgctccgttcgttaaataaaacatcccgatttatcccataaaaaagacagtgtttccgtagggcgatcatatgcttgggaacactgtctttttgtttattttgccttcaaaaaaacacgtacgtcttttttcggaaacatgtacatgtttttcacgaaacacgtacatgttttttcaaagggcattacatgattaaaaactcatctttacaccggcaaaataacttctcgggctagccgggccatagatataggaggaatcccggttcttaccttggtcaaagtcggattggtaagcgttaaacagattctgcacgcctccatttacttctagtttcagctctttgtaaagcgggaactcatacgcaagcttgatattcatatcaaagaaatccggagtctccaccgccttatccaaaggtatatatcccgccaaatgctgcaccaacatacttcccgtataggttcccgacagggaagccgtgaaacgtttgaaaggcgtaagggtagccgtaaaataaccatagatatccggcgtacggaacatctttgtctcggctggcacattctcgtcatcgctccatttctcggcctctttataacggcttcgctggaaagtagcgcccgcttgcaaagatagccatgaagttaacaccgactttccttccaaggttaatcccatcactttcgccccggaaccgttacgacgttccttaatcagattgccttgctcatctttcccaatatcttccaagacaaacacatcacttaagctggagtaaaaaccttccaccaagaagttcaactggataccattcttaaaacgatggtaaaaatcgaccgaagcactcaagctctgcgatttctcctcggataaatctttcgcacgctggatcatagcgacctctccgccgaccgccgagatatgcatatcctcatcgaacgcttgcggggcacggaaaccactggaataactagcccggatattgatatcttccgtcgggttaaaacggatattcgcacgagggctgaatattacatgatccatcatattatgtttatccaaacgaccgccaatcaagaagctccatcgcttatttttccactcattctgcaaaaacgcactctcgatatgcaccttctgattcgtaaagcgattatacccgatcatctcgtctttcaaatgatcgaaactatactccaaaccggcagtcaaatccgatggcataaacaagaatttatcaaaactataagcatattgcgtaccggccataaccgtcaggtccgtagtcttgccgtaagcgttcggatcttggttcgtcccgtaataactatcccggtctgtattctgggcagaagtgaaaacactccatttatgtttgtaatccttggagaaaagatcgaatttcagacctcctccatcaatcgaatgctccaactgttcggcgatatccgcttcatgaggcggacgatccaacagatttcctcccctgcggtattcattcatatgatgatactcgaatgtcaatttactataagtactcgttttcaggtacgaacggaaaccaaccgtttgattcttcaatttaggcaactccgtaaaaccatctccatcctgatcaaaaccggaacgatgacggttctggccaaaaagatataagcccgctttcccattttccgataccaaagaggcatttagggtcgtattattatcgaaagcagatgtcccgccaatcgaggttaacgtatgcgacaattccccggaatttctcaagggctccttcgtgatgatattaattgtcccggcgatagcggacgagccgaacagtgccgatccccctcctcgcatcacctctacccgctcgatcatattcgccggtatttgctcaagcccatatacgccggataaagcactgaatatgggacgtgaatcaatcagtatttgggtataaggtccgtctaatccattgatccggacttgctggaaaccgcaattctggcaattcgtctccacccgtacacccggttggaaatttagtccctgtgccaaattcaccgcattggtcgtagtaaaaaccttcgcatccaatacattcactaatgtgggagccaaccggcgggaagtttccgcacgattcgcagataccaccacgccatccaaggcgatctggtcttcttccagttctacattaatctctaaggtttttcctttctttaggctcacttctttagagacagtcttatacccgagcgctttatattccagcgtaaatttaccttccggcagattcttcaggaaataatgtcccgagttatcggtggtcgtaccgatcgtggtaccttttaacaatacgttgataaagggaagatgttcccctgttttcttatccaagacatgtccgaaaacatttgcgtctgagtcgtttagacggtcctctcccgtggcctgagctaccgttagggcacagcacaggcatagtataaagatgaaaaatttattcattttaatttattctgataagtaatacaatgttattaatctcacaatatcagaatatgggaggagcccgaagcgtacgtcttccccggaagggaacgatatagtccggatagaccggagcgaaagataagttacggataaaggaataaaaagccgccagcagaatagcgacgaaagccgcacctgttatctgcaagacagataactgatgaagcaactgaaactcggcgtagccatgttcatggtccggacgaccatcgtccgttttatgatacgggtgagaatggacgattgttaccccgttgacaatatgaacgtgggtaaacgcaataatacatcccaaataggctatgaacagcgcagggagtaatatcctcagatattttcttaatctatccatctcttttctctcgatcgcaaatatagtaatataaccgataaaagagatacgctgttcaaaaattacctatttgtaggtatttcatcaaccgagtacaccacgtacccgatcttcaaaggccgaaagggccgctttggcgccttctcccatagaaataatgatttgcttaaagggtacggtggaaacgtcgcccgctgcataaatacccgggacattcgtccggcaatgtgcgtcaatcacgatctcaccgggacgatttgtttcgacaatctccttaaagacaccactattagcggctaagccgatttgaacaaaaataccgtctaaatgaataacacgctcttcccctgtcttacgatcctttgtacggataccggttaccttgtcgccatttccaaccacctcggttgtttgtgaactaacaaagatctcgacattcggcaaactcttcgctttctcttgcaagacttgatccgcttttaactcatccataaactccaaaacggttactttcgaacagatccccgccaaatcaatagccgcctcgataccggaatttccaccgccaaccacggcaacatgttttcccttataaaacggaccgtcgcaatgaggacaaaaagccactccacgccctatatactctgcctcacccggtacattcaatttacgccagctagcgcccgtagcgacaataaccgccggagccttgaatatctcacctccagccgtagataaaaccttctcgtttccttctatcgttaccttctctatacgacgatgctccagcaggtcaatcggatattgccgcatatgcaagcgcagattgtcagccaactgggtacctgttgtctccggaactgaaatcagattctcaattcctaccgtctccttcacctgcccgccgatacgctccgccacgacagcgacactcagcccctttcgtgcggaataaatagcggcagaagcaccagccggacccccaccgaccacaaccacgtcatatcgttttaccgtcttctccgtcaggctctcattgattccatactgagcttccagcttcgataacaattcaccgaattccccacgtcctacatggatcagttttccatccgcaaagacagaggggacgccttgtatcttcaaggcatcaacttccgcctgattgatagccccatctaccatctcatgatggatctgaggatttaaagtcgtcatagcgtttaatgcctgtaccacatccgggcaattcgtacaagtcaaagagacataggtcgtcagatgtatcgagccattcaaggctttaacacgattacaaatactctcgtccggaaaattcttgcctttcccatctgaattcaagatcgccaacagcaaggaagtaaactcgtgtccattaggtactccacgaaacttaatccccgttttcgctccatcctttaataaaatgaattccaatccatccccatcagatactcgcatagatattttatccgaacaagaggcaacatcacctaataaatccaacaactcttgtctactttcatgcgcaggagagatcgatatatcaaaggtataattcgcatttaaccctgcgaatataccttttaattgttcttttaatgttgattctaacacgatctatactcttaattatttagattttccctaccaagtcaatgctaggtttcaaggtagcctcccctttcttccatttagcgggacaaacctcaccatcatgtgaagcgacaaactgagcggcttcaactttacgaagtaactcggaagcgtcacgaccgatattgttatcatgaatctcggccactttgatctttccttccggatttaccaagaaagtgccacggtatgccataccctcttcctcaatcatcacaccaaacgcacgactcagtgctccagtgggatccgccaacatcggatattggatcttacggatagtctcggaagcgtcatgccaagctttatgtacaaaatgagagtctgtacttacagagtaaatttctactcccattgatttaaactgctcatacttctcagccatatcgaccaactctgttggacaaacaaatgtaaaatcggccgggtagaagaaaaagatagcccacttacccaaaacgtcctcgttggttacagtcttgaaattaccattttgaaaagcttgtactttaaactccggaagttgagaattaataatcggttccatacttgttcctatttttaaatgaatactatttgtttttatttccgatacaaaaatataacatatttcttcattaaaacaatttttctaatcgatatattttatgaggttatagataacactttatcaatcaataaaaagggcctatcctcacggataagcccttcaatatcttgggttttggattactacataattagcgattataatttactttatatacttaattgattcttttgtatccgtatacggcacggtctcccaattcctcctcgatacgaagcagctggttatatttagccatacggtccgaacgacttaatgatcccgtcttgatctgtccgctattggtagcgacagcgatatcggcgatcgtagcgtcttccgtctcaccggaacggtgtgaagtaacggtcgtgtatccatgacggtgagccatctcgatagcgttcagtgtctccgtcaaggaaccgatctgatttaccttgatcaagattgagttaccgcaaccttctttaataccccttgaaaggaactctacatttgtcacgaacaaatcatctccgactaattggcaatggttaccaatacgatctgtcagtttcttccaaccagcccaatcattctcactcataccatcctcaatggaatcgatcgggtattcgttgatcagcttttccagataatccacttgttcgtcggaagtacgtttcactcctttttctccttcaaacttcgtgtaatcgtagattccatccttataaaactcagaagaagcgcaatccataccgatcatcacatccttgcccggttcataaccagccgccttgatagcggcgataattgagttcaaggcatcttccgtaccttccaaattcggggcgaaaccaccctcatcaccaacagcggtacttaacccacgatcgtgcaatacctttttcaacgcatggaatacctcagcgcccatacgtaagccttccttgaaagaagcggcacctaccggacgaatcataaactcttggaaagcgatcggagcgtcgctatgcgaaccgccattgattatattcatcatcggaacaggcatcacgtaggtattcgttccaccaatatatctatataaaggaatatccaaataatttgcggcagctttcgctacagctaaagaaacgccaaggatagcgttcgcacctagtttcgatttagttttcgtaccgtccaaagccaacatcgcatgatcgatacctatctgatccaaggcagacatccccttcaatgccggagcgataatcgtattgatattctcaaccgctttcaatacgcctttaccaccataacgcttcttgtcgccatcacgcaactccaaagcctcgttctcgccggtggacgcaccggaaggcacagacgcacggcccataacgccggactctagtaaaatatcaacctctactgtcgggttacctcttgaatctaggatctcacgtcctgtaatcttttctattttcattgcttctacgttttttaaactgacgcaaatatagatggattacttgaaccgtgaaatcaccacaaattgctattttcacctcaataatacctgaatgtaggtagagactacaacactcccgcccgcacccggctcaaagattcgggtgtcatcaataaatacgaggcgatatgattgacagaagcacgtttcgctgcttccggatattcctgttgaaaacgcagataacgttttcttgccgactcaaaacgccaagagtccgctttctcttgcgaaagcatcaaagcccactccagtattttctggtacaatctattaatagctaaagatgttttcaataaatcgctaaattccgaaaaagagatccggtgataaaccgtcggttccaatgcctcgattaataaacgcgtcggttctctttggaatgtgctggctatacaaataacgatatttccctcacaggagaaatgctcggtaatatcacgtttattcttatagtaaaactggcgtaataatcccgattccacataatataaatatttagatatttgtccgttatccaacaataattctcctttcgcagccttacttgattctatgatcgaggccagagaatccaaatccgcattgggtaatggataaaaacgtttggatatcatttcggctatttcttgtggtgtcttcatactattcatcattttctgatctatatcattttttatctccttacaaaaatagatatttgttgcatataacaaaacaaacacatattaaatagtcaaggttagtctaggcaaaaaattattactatcgtttaaaagctaatcggattagattgttttccctgattagctgttgcataatcgcaaggcttgatcgagagatcaggccttgttattttctggtttgtagcgagagaatatcgctttcgcattatctaaacgttcttttgataagggttccaccccctttaacggataatcgaggcctaattgctcatatttataggttcccatcgtatgataaggcaataattccactttgcgaaccactttatatgaactgacataccgagctaacgcctccagccactcgtcattatccgtatatccggggacaataacatggcgaatccaagtatctatgccacgtctctccaattcatccaagaacagaagcgtattatcctgcttgacacccgccagtaacggatgtaaatccgggtttaaggttttgatgtccaataacactaagtccgcataatccaagacttcccaagcttttgaggtacatacgaaaccagatgtgtccaaagctgtgtgaagaccttgctcttggcacaaacggaaaaactctttcagaaactcaggttgcaataaaggttccccaccggtaacagtcacccccccacgggcgataaaactcttataccgtaaaacttccgtcaatagctcgccgggagtcatctgatatttcaccttccctttcgggttccaagtatccgggttatggcaatacaggcaacgcaacgggcagccctgcataaaaacgacaaagcgaattccgggaccatctacggtcccgaaactctctaatgaatgtatcttaccttttatcacttacagtgaatggttaatggttcttgaaataacatccaactgttgttcacgagtcagtttcacgaagtttaccgcatatccggatacacggatcgtaagttgcggatatttctcgggatgttccatagcgtcgatcaacaaatccttatcaaatacgttaacattcagatgctgacctccatccggagtaaaatagccatccaataagctaaccagattattgatctgcatttcacgctcctttcccaacgtagccggagaaacagcgaaagtataagagatgccgtcgtgcgcatgctggaatggaagcttcgctaccgaagctagcgcagcgatagcacctttcgtatcacgaccgttcatagggttcgcgcccggagcgaaaggagttccaccgatacggccatccggtgtcgtaccagtcttcttaccatataccacattagaggtgatcgtaaggatggactgcgtaggtttcgcatggcgataggtctcgtgctgacgcaaatattccatgaacttctcggtgatctctacagcgatactatccgtacgatcatcgttattaccgaaaggaacatattcgccctcacgttcgaaatcaaccgccaagccacgctcgtcacggatcacacgtactttcgtatcacggatagcagccaacgaatcggcaacgatagaaagaccggcgatacctgtcgcacggatacgctctacatccccatcgtgaagcgacatctcgaatgcctcatacgcgtatttatcatgcatataatggattatcttcaaggcgttcacatacactttcgccaaccagcgcatcatttgctcatacttagccatcacctcatcgtattccagatactcgccgcgaaccggctcgaacatcggggctacctgtacgccgctgcgctcatcccgtcctccgttgatcgcatataataaacatttcgccaaattcgcacgggctccgaagaactgcatctgcttaccgatcttcataggagaaacgcaacaagcgataccataatcatctccataatccggacgcatcaaatcgtcgttctcatattggatagccgacgtatcgatagagaccttggcacagaaacgtttccagttctcgggagcgttcttaaaccacagaaccgtcaaattgggttctggtgccggacctagattatataatgtatggagataacgataggaagttcttgttaccaaagaacggccatccactccttggccgcccaaggactctgttacccaaaccggatcaccggagaacaaatcattgtattccggcgtacgtaagaaacgaacgatacgcaacttgatgatcagctggtctactaactcttgcgcctcctcttccgtcatcttaccctcacggatgtctttctcgatataaatatccaaaaacgtagaagtacgtccgatagacatcgccgcgccatcttggtcttttaccgccgccagataagctaagtacacaaactgaaccgcctcacgagcgttttgcgccgggcgggtcacgtcgaagccataactagcgcacattctctcgaacgctttcaacgccttgatttgctcagaaatctcctcacggctctggataatctcttccgtgatctcttggatatccaaacgattcaagaaacgctttttctcctcgatcaagattgccgtaccatataaagcgacacgacgatagtcaccgataatacgtcctctaccatacgcatcgggcaagccggtgatgatagccgaacgacgtgcggcaaccatctcttccgtatatgcggagaaaacgccctcgttatgcgtcttacggtacttcgtgaagatctctttcgtcatcgggtctaaatgataaccgtaggcttccaagctattctcgaccatacggataccacccttcgggaagataccacgtttcagcggagcatcggtttgtaacccaacgataacctcattctccttatcaatatagcccggaccatatacatcgatcccttgaggtaattttgtctcggcgtcataaactcccttttctctctcgaccttaaacatctcggtcagcttgttccagaccttacgggtcttctcggaagaagcgactaaaaaggaatcatccccttcataaggcgtatagttactctggataaaatctcttacattgatctctctcttccaggtctcacccttaaagtgatcccagtactcattctcaaatttcataaacaatcttatctaataccacatttttaccggcacaaaggtaaaacttttatcctcatgttcctgtaacatttgcgacacccctctaaaatccctataaataggtattaaaaatatacaagaagaaacgggatagtaatgcgatgctttgcacgaagtctccattttattcactatctttgcctacagaacgtaaaagttaatctggatcaaacacatgagaaatatcctgtttaccgttttatttataggaatactatctttaatcgcatctcctatctcactcgcgtctaaatctttgcataaggcaaatatgattaatttgtcgaacaatgccattatttgcatgcatcaagatccggatggctatttgtggatcgggacttacgacggacttaacttatacaacggaaaagatacgtatgtatatcgtttcgaattaaataacaaaaactctctttgtagtaatatcattcacaaaatatccgacgcagaacccggctttttatggatatcaacctctttaggtatcaataaattctcgctaaagaaacggaaagtcaccgagtcttacccgggatacatggagagtgatctggtagcgaccgattcatccggtatcacattagccatttgtaaagaaaaccggatatcttgttacaccccatttagcgatggattccgggatctgccgagagaagggataggccctcaaaccgtacggactttattcgccggaacagacggatatttttatttactattgacctcgggaatactgaaaaagttaacaccggatttctccaatacaacttttaatttactatcggaagaacgccaattccataataaaccgatcttatccgcatttcatgagaataaccatatcttcattgtcgataccgacaataagttatatcgccaacaggtagacggaagcgggaaagaattcctgtttgatctgtctggaatgacaaataaatatggaaacatcattaagatatgtaccttccaatccaatgtatatatcgttttccgtaacggcaatattctagacctaagccaaccggaaaacacgatagacacgggcatcggtatcttttgcctgatgaacgataaaagacaggagattctttgggtagggaccgatggacaaggcatacggatgttttacgataaacccgatcttttcggctctatcttactcaaggatttaccgattaatatacagaaccccatacgttctttatatacagacaatgatcgatccctttggttcgggacaaaaggagacggaattgtccggatacaagcctatgacacttacccaaacaaaaaggcgattccacaaagcgctatcacgcatttcaccaccgccgacggattatccagcaaccgggtatatagcttccagagaagcgaattccatccttgtatctggatcggtacggaaggcccggggctctgttattattcttataaagaaaatcgaatgaagacgatcccgcagcaagaggacactccccctatccgctatatccattctatttgtgaggtaaacgactcgacattatggttggcgacaaccggcaacggattactgaaggttactttacgtatggataaagtcacgcctacaatcagtaagatacagaccttcccgctaaaaaacggggagaatacctgcaaagagattcaatccatgatatatgataacgactcgaccttatttctcgggagtcgtggcggttatggggttattagttttaacatattcaaccagaaatatgagttcctgcaaaccaacaatttaaggaatccggccattggagacgtgttatctgtatgccagaccgaggattctactttctatgcaggcgccagctccggacttacccggattaaatttaaaagaggaaagatacatttacgccaattcgataaaagcaacgggatcgcaaacgacatgatccatggcattcatgaggggaatgatagctgtatctggttaagcaccaataaaggtctcaccaaatataatccccggaataattttttccataattatcatcaaccttattttagcgtcacggaattctctgatgacgcttattggaaatgcccatactccgagcgtttattctttggaggcatcaacggattagtctgggtaaataaacaaacggagccggagcatacctatcaaccagaattaagtttcttcgagttgcaaatggataaacaaatccttccattatataagaacatcagccagaacggtgtaacggttccggctgatgtgcaatcgttaacgattgcgttcgtcgctccggattacatcaacggggagaattacgagtattcgtatcagttggtcaactataattcctcttgggaaaaattgcaaaagacaaacaaggtaactttcatgaacctcccgtacggggaatacttgctgaaagtccgttatcgtaacgatgtcattgattcgtcggcaaaagaatacaccctacctatcaaggtattacctcctatttatctaagctcattagctattttcacgtatctttttatcggtacggttttaatcatcattgccatctatcgcatccattaccaaatactaaagaaacagaaacaaatagcagacaagatcaaggaggagcaaaaagagaagctatacgagtctaagctgaatttctttacccatatcacgcatgagttatgtaccccgcttaccttgatcaatggcgtggagaattatatccaagcctatgccgccacctcaaaagacaagacattagaaaaatacacttcagtcctccgggaaaatgtagaggaactgaacgggcttatccaagaaatccttgatttccggaaagcggaagacgctggattcagtcatacgcacatccgaagagtatccgtatcctctcttttgcgaactcaattcgaatggttttacccactatccgagcaacaccaaatccaattcaagatcgatgctcccaaagagctttattggaatacggattccgtctatttcaagaagatcctagcaaatctgatttccaacgcatttaagtatacggaagacgggggcacggttcgtatctccttacatgaggaggagaacttcctcgtccttaaagtttacaacaccggcaaaggaatcgaggaggcagacatgcaaaatattttcgaccgatatcgtatccttggcacgatggataacgacgataacaggcaaaatacggcacggaatggcctcggcttatttatctgccacagcctcgtacaatccttaggtggtaaaatcgacatagagagtgaggtcggccaatatgctgaatttacagttaccttaccttttggcatcgtagaggagagctcagacgacacgatagacgaagatattcccgtatcgcttccttccccaaacacggatatacaaaagccgcaaatctcacatacggcacaaaaagagacggaagataaaccgatgatactcgttatcgacgatcataaagacatcgtctggctaatcacggaaaccctctcttccgaatatcaggttcaggaagcttataatgcggaggaggctctggaattcctcaagcaatacactccctcccttatcatcaccgatatcatgatgcctaatatcgacggattggaattgatctctcttatcaaggaaaatagatatacccgtcatatcccgcttattatcgtatctgccaaaatatcagaccaagagcaagcggcaggacttaatataggagcggatgcctatctaaccaagcctttctcgccaacagttctcctatccgtcgtgaaccgattgatgacaaatcaaagagaattaaaagagtatttctattctccggaaagtgcttatcaatatacggaagggcaattattacatcaagaagacaaggaattccttgacgccgtaaccgctatcatcaaagaaaatgtcagcaaggaaggactcggtcccgagctggtagcggacgcactgaatataaacacccgcatcttatatcgccgtttcaagaaaatatctaccatgacgccgagtgattttataaaggattataggttaaactatgcagcgcaattactcgtaaataccaacatgagcgttcaggaaattatttataatgtagggatttctaacaaatcatacttctatagggagtttgcccgtaaatataacatgactcctaaagaataccgcacaaaagaggcataaatcattgattcctaaatagtgtcataatctaccaaaagagtatcataatctgccatatgcatttcatgacacttcttcggcatttcaaagcactcttcaattcgttaagacctattaatattgctgtcgaataacaaagcaaaccgcttgtgtgtattcttccttcgggaagcacattattaacttttaatttaatgtttttatgaaaaaaaagagtgaaggtaagacgaggaaatgcctgactttattaggtggacgaacctctttgttactttgtttatctttaatgtttcagtcctcttatgcggccgaagattctactgttcctgaaatgggaaacatggagattcatcagatcgcacagcaaagttcaaccattaaaggtgtagtaaaagaccaaaagggtgaacctctgattggcgttagtattgttgtgaaaggaaccacgaacggaactgcttcggactttgacggaaatttcaccttggatgtaccggataacagcacattggtattttccttcatcggcttcaaatcccaagaagttcgttataccgggcaaaaaacattgaacatagtcttagctgaagactctgagacactagacgaggtagtagtcgtaggttacggttcccaaaagaaaggtgagatcacctcatccgttaccagcgtgaaagcatccgactttaacaaggcaccggtagtgaacccgatgcaattggtggaaggacgtgtagctggtctgactgtatcgcgtggtagcaccgacccgaatggcgaggtaaaagtacagatgcgtggtgcctcatctctgaaaggtagcaatgagcctctcgttattattgacggtatgccgggtaatatgacttctttgaacgctatcgcacccgaggatatcgaggcgatcgacgtattgaaagacggttccgcagccgctatctacggaacccggggtaataacggtgtgatcatcgtctccacgagacgtccgcaagccggaactactcaagtggattactcaggatatatcatgcacgaggcggtttataaacggccggaaatcttaaatggagacgagttcgtcgcttatggcaaggaaaccaacaacgccaatatccgcgactttggtggacgggataaccattacgacgctttattgaataagagtaatttcacccatgtacacaacttgaccgctactggtggtaatggtaagacaaactatcgcgcttctttaaattacaaaaagaatgatggtatgatccgtaacaccagccgtgaaacgatcaatggctctatcgctgtgaaccaccgtgcgtttgatgataaactacagctttctttcaatctagcaaactctttcgtgaaagtggacgcagtttccgatgatgtggataaggtaggagatatccctaattacggcatattataccaggcgatccgtatcaacccgacgatgcctatttataaggaagacggctccttctgggaaacttacagcggttacgaagatttcaacccggtagcccgcatataccagcgtaccaagaaaaaggaattcaagaatttattggcgaacttcaaggctcaatatgagattatccccggtctgacagccgccgctttcttcgctatggagaagaacgacgcattaactaacgattatagcatgcgtgaggaatatagccaatataaagacggtacaaacggacgcgccaaaaaagaatattatcagaataccaaccgtactactgaatggacagcaaactacaatacttccatcaacggcgtacacaatattaccggtttgctgggatacagttaccaagattttgaatacgagcaattcagcgccgagaacaagaacttcttgacggacgtattcggtaccaataacctagaagccggcggttacctaaaagatggtaaggccgagatgaagagtaaaaaagagaccagcaaactgatcgccttcttcgcccgtgccaactataattacgacggtaaatacatggccagcgcctctatccgccgtgaaggttccacaaagttcggagcgaacaacaaatgggcttggttcccctccgtcagcgcaggctggatgatctctcgtgaggacttcatggagagccaagaagtattcgacgtattgaaattccgtgccggtttcggtatcacgggtagtctacctaccgatccatatatgtctctcgctacctacggcacaggtgctggagcttggaacgcttacaccggttcatggctaaccgccacttacggtccgaatatcaacccgaatccggatttgaaatgggagaagaatgagtccttgaacatcggtttcgacttcggcttgctaggtggacgcctaaatggtacgatcgattggtatagtcgtacgactcgcgacttgatcagtagctacaatgcccaacagccatccttgatctacaacacgatcaccaccaacgtaggcacgatgagaaatagaggtatagaattagcattaaacgcagaggtcgtaaagactaaggatttctcttacacggctaatttcacgttctcatacgagaataataaattgacatctttgtctaacgacgtgtacaaatcttcttacgaggatcaatatgacctgccctctccgggtaacccgggcaaggcttaccgcctacaagaaggacagccgatcgcatcattcttcggttatgtatgcgatggtatcaatccggacggaacttggaatcttcgcgacatagacggaaaggaaggtctgtctgacgctgaccgtacctttatcggtaatggtttgccgaaattcaaggctggcttacagaacacatttacctataagaactttgacttcagcttcttcctgcgcggtatgtttgattatgacgtattgaacgagggtgctatttatttcggaacgactgttaatatcgatcagtctggcacaaacgtatacaaggatgccttgaagaacaaggtaacagagcaaccattgttctcttcttattatctagagaaagggaacttcttgaagatcgataacgtgacactaggttatacattcaacttcaaaaataataaatatgtgcgcaacttacgtatttatggtaatgtcaccaatcttgcgactattacaggatactctggtttaacccctgacgtaaacgtaacaggactacaagcaggtatagagaagcgcggatcttatcccaccacccgtaccttcacgtttggcgttaattttggattctaattaagtaacaatagatttaagacaatacaatgaaagctttaaaaaatatatgcgcaatttcattattgctgggagctaccgcatttacctcttgtacggacctgacagaggaaatacatagctcggtaatcgctgagaattattacaacaatgcaggcgaggtaatggccgccatgatgcgtccatggggacacttctgtggaactatgcaagtagcccaatcgccttggtcatgtaacgagttatcttccgactgtgccgcatggcctcaaaaaggtcgccacggctatgacaatggagactggattcgcttacaccgccatcaatggattcctacggatggtcaagtagtggatgcttggaaaaaattatttgaaggtatcggatatgctaacaacttccttacagatacagagaatatagattttgaagcactccaagttccaatgtctaaagcacaagcacaagcggagatgcgtgtatatcgcgcttactgttattggtatgtgatggatatgttcggtacggctccaatttgcgagaaaatcggtgaaatcaatccttcctccaaatctcgcgcagagttattcgcttggatcgaaaaagagttaaacgagagtattccttctttgtcagagagtaaaacagagacctacggacgtgtatccaaatggggggcttacgcattattggctcgtctctatttgaatgcggaaatttatactggacaagcacgctgggatgattgtatcgcagcttgcgatgaattagctaagggaggtttcgcattggataagaagtggaacgacactttccgtgcggataacgacaagcgatctaccgagattatctggtcaatcgtgtatgatgaagtatatgccaaaggaatgggttggtatcaacgttggttgcattacgcacaccaaactggctgggatttgcaatccggtccttggaacggcttggtgacacaaccgaccttttatgactcattcgctgacaacgacttgagaaaaattgagggtttcttgatcggtaagcaatatcctcgcaaagtagatgaaaacggtaattactactacgacacgaccgcagagcctttgaaaggttcagaggagtacaatgggcaggatttggtattcgtaaactacattaagtccatgaccgagggcgaagaaaacagcggcgctcgctctatcaagtatgagatccaaccgggtactaccggcgatatgaacaacgactgggtgatgttccgttattccgaggttatctataacaaagcggaggccttgatgcgtaagaacgggggcaaagcaacgcaagaagtggtagatatgatcaacagcgttcgtcaacgttctttcaaggcagaggattgggagaaagcgaaatatacgaccgctacattgacaatggatgagttcttagccgaaaaaggtagagagtttgctttcgaaggaatccgccgtacagacttggttcgttttaacaagttcgtaaccacttcttggtgggacaagactgcatccaacgaaccaaagcgtaatatcttccctattccgcaaagacaattggatgctaacgcaaacttatctccgaacgaggctaactcattgttctaaatatcaactaagtatagtagaaattcattattaacaaattagcacttgacaatgatagaggactactatacttattgatctgaaaatataaaaggttacctttgtcactatcaaaggttatccttggaactatcaaaggtgaccttttatgtttcatccttttctaactaattgatacgacatgataaatctcaagaaatcgatgtgttgcctctttctggcagccagctcaacagtagcgatcgcacagaccagtgtagttgatcttgtaaacccgatcatcgggacgaatggaatgggacatacgttcccgggtgcttgcgtacccttcggactcgtacaactcagtccggatacggataccataccacacaacgtagatggtaaataccaacctcgctcctacgagtattgtgcgggttatcaacataaagacagtagcatcgtaggtttcagccacacccacttcagcggtaccggccactccgacctcggggatatcttgattatgcctaccaccggaacgttgaagctaaaccccggaacggccacgaatcccgatggcggttaccgttcccgtttctcgcatggcaccgagatatcccgtcccggatactacgaggtgatgctcgccgattatggcgtaaaggcgcaactaaccaccacccaacgggtcggcatccacaaatacacataccctacgaacagtgagaaccaacgcattatccttgatatgattcacgggatctataactatgacggcaaagttctttggaccaatattcgcgtagagaacgatacgctggtaaccggctatcgtatcacaaacggttgggcacgtaccaactatacttatttcgccatgtctttctccaaaccgatcacgcattacggatgcgaagagaaagcgaaagttaattatcggggcggttatgccaagttcaatatgaaagagaacttcccggatatcggaggacgtaagatcgtcgcttattttgatttcgatccgaaaacgtctgatgagttggaagtgaaagtcgccctttccggagtcagcaccgagggagccttgaaaaatctacgtgccgaggcttccggtgcggacttcgaccaattagccgccaaagcctccgatacttggaataaagcgctctccgtcatcgacgcgaaaggaagcgatgatcaattggctatgctttacacctccttgtatcacacgatgatcaatccttgcgtatatacggacgttgacggtcaataccgcggactcgaccataatatccatcaagcggacggattcacgaactatacggttttttccgtatgggatacctatcgtgccctacatcccctgttcaatatcatcaaccgacaagttaacacggatatcgccaaatctatgttgaaacattgcgagcaaagcgttcatcatgccttgccgatctggagccatatggcaaacgagaactggtgcatgatcggttatcattccgtctctgtcttggcagatgctatcgccaaaggattaccgatcgataaagacgccgcgttaaaagcgatgatcaacagctctacgattccgtattatgagggaaccaaagagtttatggaattaggttatgttcctttagatcgcaacggtagcgcaggctccttgactttggagtatgcttatgatgattggacaatctataatacagctttattagtgggaaaccgatccgtggccgatacctataaaaagcgtgcgtccaattacgcgaatgtattcgatacctcgatcggatatgcccgtccccgttatacgaatggtaaattcaaagaggacttcagtttgttaagcacgcacggtgaagggtttatcgagggaaatgccttgaattattccttctatgtccctcaagatgtcaatggtatgattcagttgatgggaggcgagcaagcattcatcactaaaatggattccttattcacgatgcatcttcccgatgagttctttgccgagaccgaagacgtaaccaaagaaggattactaggaggttatgtacacggtaacgaacccagccatcacatcccattcttatacgcatggaccagccagccttggaaaacccaattctggcaacgcgagatcatgaataagatgtatcgcaacaatatcgacggcctttgcggtaacgacgactgcggccagatgtccgcttggtatatcctttccgccatgggattctatccggtttgcccgggtacagatcaatacgtattaggcgctccttaccttccctatatgaaggtccgcttggagaatggtaagactttcgaggtaaaagccgataaagtcagcgacaagaaccgttatgtaaaagcggtaaagctaaacgggaaaccctataccaaaggatacatcacgcaggatgacatcatgaacggtggaacgctcactttcgagatgacttccagcccgaacaaaaagcgattgttcaacggagaggatcgcccttattcactgacggattaacccattttatcagaaaaaacagacaagactcatgaagtataaacaattaatcagcggtgctttcctgctgtggacttgcatcgcttgctccggcaaaaaggaacaggcggctacagtagcggaagccacctcaaatccttgggataattattacatcggaaagatcgatttcaagaatctttcccccgaggctaagggctcggcaatctatgccgccgttatccctgatccggaagcttatattaccaagcacgcccgcaaggtcgtagagacgctttatttcactccggaagatagtatcccgggcatcgaggagatccactatacattaaaggaatacgacggggtatccgcgaaagacggagcgcccccttccatcagtatcgtatacagcacgaaatggatcgagaaaagttttgccaataacgacactgcgaaagtggattacgagacccgtggcgtattataccatgagctgacgcatggtttccaattggagcctcaaggcataggtagctatgggactaataagactttctgggccatgatagaaggtgtggcggatgccgtaagatacttaaacggcggttttaccttggaagatcgtcccaaaggcggccattatatggatggttaccgcacgacaggcttcttcctcgcatggcttacgcaaaccaagagcccggatttcctgcggaagttcaaccgaagcacattagaggttattccttggtcgttcgatggtggcgtgaaatatgcgctcggcaatgattacgacatagactccttatggaaagaatatatggcaacgatgggagatgaagcgtagccccggcaaaggctacgaccaacggcggtaacactcaacaagttaccgccgttcttttatagtatcactcccgaccttccgccaataggcattataaggtcgcaacaatgcccatcgtaagctccttatactgcccatcctaacaaccttacaatgggcattgttacattattcccctaaaacaccttccttatttgcatttccgtaaacatatatctacttttgcgaaaaagtaaatatggaactttatacccgaatcctgttgccgaaagcacgattctctttctcgtatgaggaccgggtcgtgatgatgggctcctgcttcgccgagaatatcgggcggaaactggaagagaataaattctccgtagatataaacccattcggtactctgtataacccggcttccgtagcggaaggattgcggatgctgctacgcccggagtatttcactcccggcgatttattccagcatgagggcatataccatagttttacccatcatagccgtttctccgctccctcggaagaagaatgcctaggccatataaacagccgcttatccgaatcctccgatttcctgcgaaaagcgacccggttggtaatcacgttgggaaccgctttcgtctaccgcctcaagagcgacgggcgaatcgtgtcgaattgccataagctaccggaaaagatgttcgatcggcaacgattatccacgcaagagatcgtcgaggactggaaacctctgttactagccctttgggaacaaaaccccgccttgaaaatcttatttaccgtaagtccaatccgccactggaaagacggggcgcacgagaaccaactcagcaaagccaccctattgctagccacggacgccttacagaaagattatcccggccgaatcgcctacttccccgcttatgagatccttatggacgagctccgggattatcgtttctatgcggacgatatgctccatccctccccattggccattgattatatttggcaacgttttatcgaaaatttcttatccacagacacttcggcaatccttaaagaatggggtgatattcaaaaagctattaaccataagccctttcaaccggatagcgaggcctataagcggtttatccttcaaactttgttaaagatggaacgaattagcgagaaaattccttcctttgatatcagaaaagagatcgaaatagtaaagtctaaactaaaataaaagaatggaatacgcaattaaagaaatagcaagagttatcggtgctaaaacaaaccaattgcttgacgatacggtcagtttattgttgactgacagccgtcgtctctccttcccggaaaaaagcctcttcttcgccttgaaaaccaagacgaacgacggacatagatatatacaggaactctataaacttcgtgttcgcaacttcgtggtaagcgatatgctaccggagttcgagagcatgaaggacgcaaacttcctgatcgtaaaagatacgttacgagctttacaaaaactggcgactcaccacaggaagcaattcaacatccccgtgatcggcatcaccggtagcaacggaaagacgatcgtaaaggaattcctctatcaactgttgcataacgagttcaacatcgtacgttcgcctcggagctacaactcccagttgggggttcctctctcggtatggcagatgagcgagaaaaatacactgggcatcttcgaggccggtatctcacaaccggacgagatggaacgcctgcaacccattatcgcccccacgatcggtatcatcacgaatatcggggaggctcatcaagagaatttcctctcctccaatcagaaatgtatggagaagctgacgcttttcaatgattgcgaagccattatttatgatggggatgatttatttatcgccaattgtatcgaatcggcttgcctttctcataaagcgatcgcatggagccgtacggactccgaggctcctttgtttatcgagtctatcgataagaaagagtttgagacgatcattcactgtactttactgggcttcaaccgggtcgttaccattccgttcacggacgacgcttctatcgagaacgtgatccattgtatggcggttatgctttacctaaaacccaccagcgtaaacgacgtaacaaaattcttgcatcttgagccggtggctatgcgattggacgtaaagcaaggtatcaacaattgcctgttgataaatgatacctataactcggatatcaactccttggatatcgcgctcgatttccaacaaagccgccgggtaggcaagcaattaaagagcactttaatcctctccgatatccttcaatcgggcaccttgccgaaatctctatataagaaggtcgccgatttggttcgccgtaagaagatagatcgtatcatcggtatcggccgcgacttaaaggaatatgcttccgtcttcgagatcgagaaggagttttacacgaccaccgaggaatttatcaagtctccttccttcaagaaattcaaggatgagttgatcttgattaaaggttcccgccatttccatttcgagcagatctccgagttgttggagaagaaagtgcatgagacgatcctagaggtaaatctggacgcgatcgtacacaacttcaatcagtatcgttccaagctaaagccggagactaagatggtttgtatggtaaaagcttttggttatggagccggctcttacgagttggcgaagacccttcaagaacatcgttgcgactatctggccgtggcggtagccgacgagggagccgaattgcgtaaagaaggcatctcgatccccattatcgtcatgaatccggaattcagcagtttcaatgtcttgttcgagaaccatctggaaccggaagtctatagcttccgcctattggatgccatgatccgggagaccgagcgcagagggatcacctcttaccctatccatatcaagatcgataccggcatgcatcgcctagggtttcaaccggaggatgtcccggcgatctgtgaacgcttgagagcgcaatccggggttatcgcccgttcggtcttctctcatttagccggaagcgactcgtacgtcttcgatgattttacccatcaacaattggataaattcaccaaagccgcaggggaactagaaagcgggttagagtataaggtaatcaaacatatcctaaactccgcgggaatcgagcgtttcgccgcttatcaaatggatatggtacgtttaggtatcggtttatatggagtaagcgcatccggacaaaaaggcttacggaatgtcagcaccttgaagacaacgatcttacaaatacaaaacgtacccgcaggggattcgatcggttatagccgtatgagttatgtgaaacgtgattcccggatcgctatcatcccgatcggatacgccgacggactggatcgccacttcagcaacggaggtggggaggtcttgatcaatggacaacgctgtccgattatcggcaacatctgcatggacgcttgcatgatcgatgtcaccgacatccatgcgcaagaaggcgacgccgtaattattttcggcgacgaactaccggtgagcgaactttcggataaactgaaaacaatcccttatgagatattaacctctatctcgcctcgggtaaagagggtttatttccgggaataagaagtaaccgccaacaaagaatggctctaccttgttttaatatcaaggcacatattcaaatgtcaggctatgatattcatttgcgtatgttgcacattttgtgtatgtttgtgccgtaattaataaacaagaggtatgagtcataatttattgaaaggcaagagaggcattatcttcggtgcgctgaacgatatgtctatcgcctggaaagtggcagaaagagccgtagaggaaggtgcgactatcacgttaagcaatacgcctatcgctgttcgtatgggtcaggtagatgctttggcggagaagttgaatgcgcaggtaatcccggcggacgcaaccagcgtagaggatctggagaccgtattcgcgaagtcagtggaaatattaggtggtaaaatagatttcgttttacattctatcggtatgagcccgaacgtacgcaagaaacgtacgtacgatgatctggactatggaatgctggaaaagacgttggatatctccgctatttctttccacaagatgctacaggtagcaaagaaacaagacgctatcgccgagaatggttccgtggtggcattaagttacgtggccgcccagcgcacgttcttcggatacaacgatatggcggacgctaagagcctgttggaatctatcgcccgtagtttcggttacatctatggccgtgagaaaggcgtacgtgtgaacacgatctcccaatccccgacaatgacaaccgcgggtagcggcgtgaagggaatggaacacttgatggacttttctaacaagatgagtccactgggtaacgccaacgccgacgagtgcgcggactattgcgtaatgatgttctccgactttacccgcaaggtaacgatgcagaacctataccacgacggtggtttctcaagcatgggtatgagcctccgggccatgaaccaatatagtaaaggattagaggaatatacagacgagaacggacacattatctacggctaatatgttagtgagaatctatccggagaatccgaatcaaaaagaaatagacaaggtcgtcaaagtcctgcaggacggcggccttgtcgtttatcctaccgacacggtatacgccatcggttgcgatgcgctgaacgtacgtgcggtagagaaaatatgtcagatgaaaggggttaatccacagaaaagcaacctgtctatcatctgctacgacctgtctaatcttagtgaatacgccaaggtaagcaacgccgctttcaagctgatgaagaaacatctgcccggtcctttcacctttatcttacccaccagcagcgagcttccaaagatttacaagaaccggaaagaagtcggaatccgtgtaccggacaataacatcacccgtacattggtacaatccttgggaaatccaatcctaaccatgtccatccgtgacaaggatgaggtgatcgaatatacgacagatccggaattgatacacgagaaatacgagcatcaagtggatatcgtaatcgacggcggtttcggaggattggaagcctctacggttatagattgcacgacggataatttcgagatcgtacgtcaaggcaaaggagaattgtagctatccaccacgatttgtattcgctcttccggcagattagcgggaaactccaagcttatttcttgttggtcacccggcattagcgtaatatagttatccgaataatgtaccggtaagattcgtttgcctgtctccttatcaaagaccttgatacggttgaagaacgagatctgcgaatcagcgctcagacggactgtacctacgaaattcgatccttccttcttgatctcggtcttgattcccggtcttgacttcggaagttgagataagctggtgtagtctttcggctcggttgtcagccaataaatattggggacatccgcattcaaggccagccgtaagaaataagcgcctttgatcccttccggaacggggatatccaataattcctgtaccgtattcgccttggcgctcgctctcgtctctttctcccaaagcagtttgccttccagattatagatacgggctacaatcgataaatccgtataatctttcagggtcgtattcaacaatcccgccttacgggttaccgggttataataggcatgtaagggctcacagcctttccgggttccgtacaaggaagcatttacatcgagagaccaatcatacatttgcccccgcaaggatgtccatggattctgggttttccagatcaagatacccgtataccaatcccacatatgagaggcccagccttccataaaactacgatattggtcatagttcacgacttgggcatacttacaataagtctcgatatccttcacctccccataacgctccagatgatcgccatagcccagatccttatgataccgccacgtataattacgggtcaaacctttccttgggaaaccggccaaatcctgttccgtcatcatctcccgcatactctcgacctccggggaaccaaccgatccggcttccggattaaacggatgcgaacggaagctaaagaaccattccggctcttgtataccgtaaggaccatccccattatcccccaaaaaattccgggtaaacaacgtatctgtcgagaaactcacgaaaagacgctccggatctaaccgggggaaaacctcctttctcaaacattgatcgatatctttagctaaaggccattcattcgccccacaccagaaacaaagactcggatggttacggatcattttcacttgatcttccacggaggcgataaataaatcatgattatcgggatattcccaacgacgctctcgggaatccatcttggtcgggtcctcccaagcgccattgcaatcaccactgccccacagatcttgaaagactaagataccgaactcatcacaggcgttatagaattccggccgttccaccaacgcacctccccatacacggatcatacgcagattcatttccgcatggaaacgtacctcatcccgataacgttccggagagagacgaagcaaccaatcggaattaatatagttaccacccgtgacatatattttctgtccgttcacgaagaaacggcgtcccccgttatccgggcatttatcggaagtaatctcccggataccataacgcaaccgttcccggtcactcacttgattcccgatctcaaaagagaggttcatatcatataaaggctgctcgccgataccgttaggccaccataaacgaggattctttaccgctaaaggattcaaggataccgttttcttctcgaatggcgataaagtaaccggctgggttaagcgggttccgttcgtctcacaaaccaatagcccctttaaggaagtgctcccggtattctctagctcgacagaggtattcacaaaagcctccttttgagttttcgtttccggatcacgtacgccgggtaccttggtcacgacataaggagaggagaggcataccggcccggttgtcgtaatagatacctcatcccaaatacccgtattccggtctcgtacaggttgtatccagtcccaacccggcgtatattgcatcgtattattccgggcgatctgcccatcacccccttgtccgccatttggatttccgacatgtgtaggtggataaaccaataccgctaatacattcggggcatccgtacgaagataaggagttatattaaacgtcttcctcaagaacataccctcatgggtattccggttgatccgcttaccatttaaaaagatttccgccttataattgattccccggaaattcaaccagacattacgcccctctggtaaagcatcgatagtaaactgacgggtaaaccaatacgtatagaaatcattgccgacttcatgtatatcgggaatcaaattgttattcaacccaaactcaggggccggatacaaaccattctccaaaagcgttgtcaacaccgtacccggtacacgagccggtaaccatcctgttttatccaaaggcaccgcgctcaaccggttcccatccattttcacctcattcgctttccgggcataccaatctgagtgaatcaaggttttctctcccgattccgggatcaccaacaaggcttgcccctccgcggatacgggctttgaccagcaagccaggcaaagccaacaaaataaataaatacatctgttcatcatataatcttagatttatccttctaaagtagtacaaaattcagaagggcctcttcgcaaactcgaagaagccctttcattacatattatttaacaataagacctattaatgccgattagaaattacctacaccagctttgtcccaccatacatgagtaccacctttatcaccagagatcgaacccgtattctcttgattcagcagctcgatgcctttctgtaattccgcattattggtgttaatttccgtatctgagtagatcaagcgacgaacttgttcgttagtattgatatcaccgttactcaagtttacacgattcgggaataatttaggatagcctgtacgacggtattcagcccaagcctcacaagacaatgggaagttagcgatccatttctgagtaatgatacgttgcaacttctcctccttactagcaccttcgtcccatttaacacctagtgtattcatcgcctttatactattttccgccttaaccgggtcaacaaagtcaatctgtccactggttccattgagataagcgtctatttccgcatctgagatagaagttacacctgcaatactgcccttataagccaattcgttcttgatagaaatacgaatgccctcctcatatagatctttagcgctacctcccatgctccagccacgtaaagcaccttcagcacgtaaaaaataaccctcagcaactttcatgacagggaaagcggtcgtataagtgcaaatcactttagagaaattaccccattgatttggcttagaaggtaagttacatccgccgcgaacaccaagatactttgtcccctcctcaattgtcgagccatcttcacaagtaacagccgcttgattcttggtcacatacaaaggtaaacgaggatctttgaaaccttccaacatcgtgattaagctagcattcattccacaatcaccccactcaaacatacgagtcaactcattgctcaaaccttggttgatcaagatatcacgatcagcggaagtcaatacgcctccttgaacggcttcctccgctttttgcttcgccaatgtagggttcacctttacgatacgcatagccaaacgtagtttcaattgattagcgaccttcttccacaaagcgatatcaccattacaccaatagtcaaatgcttgcatatccgcaacagatgcagttcccttaaatccagcgatcgcttcatccaccaaagtaaacaaagcattgtagacactttcctgagtatcataagagaaagaagctccacccgtaggatcttcgataacagaactataggccactgggccataggcatccgtcaacatctggatcgcataagcttgtacgacacgcatcatcgctccataatcacttaagccttgctcatcacaagaagcaatcagacgacgggtattgttgaaaatatgaagatatacattctcatacataccaccacagaaaccacggttcaacgcataatcaacattaccggaaccattaaagttatgtggagtcatgaagtagccgctaaacaaatcaatatttaggttgaagcaatattggaacaagttctgctgcggagcatagacataagagaatggctccttaaattgggcagagaacggaagttcatctggatcaacctcatagggatcagtatttaaattttcaaaattatctgtacagcccatggtcataacaccggtagatactaccaaagccgatacagcggcatattttaaaattctatttagtttcataagatatactcaagatttagaaattaagttttaaattcaaaccaaagctacgagatgttggcaacgcaaacatatccacaccttgccagccattgcctgtaccagccgctacatccggatccataggagcatctttatagaagaagaacaaattacgtccaatgatagaagccgtcaaattcttattcgctccaaataagttacggaacgtataaccaaatgacaactcacgcaaacgaacattagtcgcattgtaaacatactgagaagtcaagatattagagttataacttgtacctccagtcgtcgtgtaatatgctttaggatcaaatgaaacaccatcaatcacaacttcacctgcatcacgagcggcacccgaacgctctgatacgccccaaccatccaaggtagcttccgtcattgacaagaccttaccaccgaccttagcatcaatcaagaatgacaatgtaaaatctttgtaatggaacgtgttagtccaacccatgtttacttttgcgttcatatcaccgacatataccaaatccttattatccgtacctcccaactcaggagcgccagattcagttttcaccggcttaccattatcgtctctcttgaaatcacgaacatataagtcaccaaaatgaccaccttcagtcaaaatcactttcgcacctgtacaatagctagctaatgtccaatctttcaactcattcgataattcaatgattttattattattgtaagagaaattgaaattcgtactccagctgaaattgtccgtaaactgattataccaacctaagctaacctcaaaaccttggttttctacgttaccggcattgatataacggttcttcaaaccagtttcccaaggagcggtaatattaaaatattgattcttcgtattggtcttataatacgtcaagtttacattgaaacgattctggaagaaagttccatcaaaaccaacctctaaagagttcgtcttctctggcttcaacgttctaaaagcagcttcttctggcgggtcgatagatccttggtcaccaatcgtataacgtttattggaagcatagataggcacatcgttacccacgatagaataagaagcacgcaatttaaataggtctacattctttccaaagtccaagaatttatccaatagagcacttacaccaacagacgggtagaaaaaggatacaccatccgtaaacgccaatgaagaagaccagtcgttacgagcgctgacatccaagaacaaaccttccttatatccaaactgagcagtagcgaacacagagttcaagcgtttttctttcagagtctctgtggtttgcatcgtataatagttcttcggggagaagatgttcggataataagcacccggggttatcacaccgttatttactttaaactccttatcaccccaaccgatcaattcgatgctagatgcgcttgtcttcgtaaagctaccaccagcagtaacggacaatgaataagtctcatcccaagttttattataacttgctaacgcatcggcatatgtttgctcactgaaagtccgggtatctttcatggtacccaataaatttcgtcccgcggtactagacgcatattcgttcaagatccatttttcatcaccacgttcataacgcaaacgccccgtaacagaaagaccttccatgatatcatatttaacactaccaccaaattcataacggttacggtccgtgataggagtctgacgattcaacatccagtaaggattggagaattgctcttgtttcgtattcgtccagttatgaacattcacgttacgaaccccgtcatatacttcatagttactcttgtagtaatcccaatcctcacctctcgggaacaggtaggcacctgtaatcgggttattcaaataaccggcagaaggctgattctcgatatgctgcttgttgtagcgggcacttacatccacatgtactttcttccacaagttaaagccaaccttagccattaaattatgacttaaataatcattctccggcataataccattcgatgagacattcgcgtaagagaaataagaagaaatattctccgttccaccagataaagagatagagttattcgttgtataacccggttgatagaatttacgtgcgtaattcggagatgtagctcctaatttacttccccagctaaatgtgccctcgtcactcataccataattattttggaatttcggcaaagacatggctgattcgaccgtcgtattactagatacattaatagcgaccttaccggcttgtgcggattttgtcgtaatcatgatagcaccattggccgctaccgcaccatacaaagcagcggcggaagcacctttcaacaatgtaatctgcgcgatatcatccggattgatagtagacatagcgtcaccaccatcacgttcgccgccataggccatcttcacctgcgaatcagatacgctcatcatcatagggacaccatccacaacaatcaacggttggttactaccgctaatagacttattaccacggaataagatcttagaagaaccacccgcacccgtagagttcggggtaatctgcaaaccagcgctctttccttgtaaagagttgatcatattcacattcttaatctcgttcaagtccttaccgcctaccgtttgtgcggaataagtcaaagtctttgattcacgtttgatacccatcgctgttacgacaacctcatccaaagcctctgcgtctgaaaccatcgtaacatcgattttcgtacggccattcactggctcctcaatcgttttcatactcaaataagagaataccaaaatagagtttgcgtcagcctctaaggtatattttccatcaaaatcagtaatggtaccggttgtagtaccttttactaacacgttcactcctgttagtggttcatttagatccttgtcaatgacgacaccactaatcgttagtttctgtgcatatcctgtaacacacagaaaaaacgccaataataagataaatgactttctcatgaaaaatcgtttttgatttaagtgattctacatttgtgcttttttaattttcatactctttttagagagatcgggctctcttttctttcttttttagtgcataggcatttactcttttttgtttaaagttattattatattcatacaaaaatctctttctatttaaaatcaaacggttatattttaaataataataacaacgtagtatcattagaactaaatcaaattaacatatttaatttattgaggcatgatgaaaatttgactatgtgttatcgcaaacacctgaaaaagtgaggaacatactgatttttgttacgttttaacttgtatgtatagttattatatatatatttgtctgtcaaaacatgaaaacgacttagttctaatgaaactaacaacaaatttcaattaacataattttccttcattatcttcttcctcctataacatccaatcgctatctgactatcatcttggaataaaattacagctttatttacaagcttcgaaaacaactcagtcaggaaattaaccattaactctaatttcttccacaaatattcaatgatttgcacagattatctctacatttgcgatatatatatatatatatattaatgtattgactatgaactggacccagctattatccggcaagcgtttcggaatggaagagtatcacgagcggaaacatgagagaactgatttccaacgtgactatgaccgtttgattttctcatccccttttcgaagactacaaaacaagacacaggtgttcccccttccgggaagtatctttgtacataaccgacttacacatagtctggaagtatcatgcgtaggacgttcattgggtaataacgtagcgaaaggacttatgcaaaaatatccggacggcagtatcaacttcccagagataggttccatcgtatcagccgcttgccttgcccatgatatgggaaaccctccattcgggcattccggagagagagcgatctccgcttacttctccgaagggaatgggcgaaaactagaagagaaagtacggaaggaacggggacgctgggaagacttcgtccattttgaaggtaacgcaaacgccatgcggttgttgacccatcagttcattggacgcagaaaagggggatttgccttaacatatagcacattagcctctatcatcaaatatccttacgcatccatctattcaggaaagaaagggaaattcggctttttccaatcggaggagggaagttatctgcaaatcgcccaagagctagggatcggacatagcccggaagccccagacaaatttcttcgttacccgttagtttatttagtagaggcggcagacgatatctgctatcaaataatggatatagaagatgcttgcaaactgcatatcctgaccaccgaagaggccatacagctattattgggatttttcgaaggagagcggttggagcatatccgcaaggtcatgcatatggtagacgataccaatgagcaaatcgcctatctgcgttcttgtattatcgggctattagtggatgaatgttcccgtgtctttttagagaacgaggaaagcatcctcaatggtacctacagcactccgttaatcagtaacatatgcgatcaagccaaacaggcttacgctaattgctcggctacagcatacaagaaaatatataaggcaaaagaagtgctcgacattgaattagccggttatcatattttcagccatctgatcgacagcttgaccgaggccgtgatgaaccaagagcatgcttacagcaaactgctcttacaacggataccggagcaatacgacacaaacgctcctactacatatggcaagatacaatgcgtactcgattatatctccggcatgaccgatgtatatgcgctcgatctataccgtaaaatcaccggtatgagcctgccggccgtttgatgttataataatgtgttagaattcttcccggtacttgctttccatgcgatcatccaagatacttagatagcttttatagcgggactcgctgattagcccatcgttaacggcctgaatgacggcgcagcccggttcatgacggtgcgtgcagttattgaaacggcattcttccgagtatttaaacaactcccggaaataatgggagatctcagcgtccgccatctcgatcgttccaaatcctttgatacccggagtatcgatcaaatagcctcccccgggaagaggaatcatctcggaaaaggtggtcgtatgcatacctttgttatgatattcggagatatcaccggtacggagattcacccccggcaccagtttattgataatcgtggattttccgacacccgaatggccggacaaaagcgtaatcttatcttttagatccgctttcaaggcatccaaaccttcctcggtccgggcacatagcgtcgaacagggatagccaatcgaggtatacaactcgattaaattctccaacgccctttgatcctcattattataacgatcaatcttattgaaaactaatttaacagggacacgataagcctcggcggtcgccaagaagcgatcgataaatatcgttgttgttataggataattcaccgtaacgatcagcatcgcctgatccaaattcgtggcgataatatgcgcttgcttcgataagttagaggcacggcggatgatataattcttacgctcctcgatctctgtaataaaagcggttccttctttattaatatcgattacgacacggtctcctaccgcgaccggattggtactctttatgtctttcagacgaaagttccccttgatcttactctctatatctcgcccgtcttccgtacggaccgtataccaactacctgtgttttttattaccagtcccctcatgagaattgaaaattgagaattggaaattgagaattggaataaggactcaatggggttccttaattctcaattctcaagtttcaactttcaattatttaaacggtcattacttctttttctttagcggcgtaaagctcatcgatctttttgataaacttatcatggattttctgaacctctgcctcggcgtctttctctacgtcctcgggaaccccatcagacttgatgcttttcttcaaagcctcaatagcgtcacgacgagcgttacgaacgctgatcttcgcgttctccgcctcctgcttacattgtttcaccaattgacggcgacgctcctcagtcaacggaggaatacctaagcggatcacctcaccgttattctccggcgtgatacctaactcagaatccagaatacctttctcaatatcgcggatgatcttcttctcccacggagtgatcatgatagtccgtgcgtccggaaccgtcaccgtagccacgttagtaagaggaacaggcgccccataatacattaccttcacacaatcgaggattttcggattagccttaccagcccgaatgtgagacaattgctcgtccagatactcaatggcgaacgtcatcttctcttcccctgctttgatcaattgtttcgtatctatcataaatatacgttttttgtttgcgaatcttttaattaacaaaagtaataaagatttccaacttcgcaaacatataattaaaatactccctaacaaaagatttataataccgtataaaagcttatcgccgtcactgtttacttaacttaggcgtaaagaatagtaagtaggctacgcccacgcacaacaccagcactgctcctacttgagaagccaacatatcggatgccacgcccataaagatcgggaagatcgtgccgccaaacagtcccataatcatcaaaccggacacctcattctgcttattcggcatagaaagcagggcttgggcgaaaataatggagaagacgttcgagtttccaaagccgatcaaggcgatacaagcatagatgatctctttcgaatgaaatagcagcaaaccgatcatcgccaataacatcaagaaaacactaaaggcgaagaatcctttcggagagacttttcgcaagataaaagccccggagaagcatcccgccgtacggaatatgaaatagaggctcgtggcgaagcctgcgtcggccaacgtcatgcctagacgttccatcaagatcttcggggcggtcgtattcgtccctacatcgatccccacatggcacatgataccgataaagcaaagcaggataaaaggcttgcccagcaaagccagacattcgccaaaggtggagggccgcccctcctctttggtctcgtggatagtggtagctcccaatagcaggatagcgatcacggcgatcaccatatagaccggaaacaagacacgccaaccgagttccatcgacggtatcgcttgggtagcaccccacatggcgatataaggcgccaagaaggaggcgatcgccttcacgaactggccaaacgtcaaggaactagctagcttatccccgcttacgatattcgataataacgggttcaaggaagtctgcatcaaagcgttgccgatacccaacagggagaaggatatcaacatgaccatatatgcgtcgtcgaagatcgggatcattagcgaaagaaacgttacgatcaagctcaataacacggtcttcttccgcccgatacggttcatcaacatccccgtcgggacggagaagatcaagaaccagaagaacacgagcgacgggaagatattcgcctccgaatcactcaagcctaaatccgctttcaggtaattagaggcgattcccactaagtccacgaatcccatggcgaagaacgccaacatcacgggaatcaatttcaaggatgaagtcttctcgctcatggcttataaatctttagggtaagcaggccatgcgccactctgcgtacaaacataagcggctacttttaccgctttctcatgtgcctcacgtaaaggttttccggttaagatcgatgaaataaacgccccggagaaagaatcgccggcgcctaccgtatctaccacctgtaccttcggggtaggaatcgtagagacctcctcctcggaaaagatcgtactatactccgccccggccgtaagtaccaaatagcgcaaaccatatttcttcatgaaccagcgacacatatcctctatcgtgccttccagaccaaacatcgggcgaagcatttccaattcctcatcattgatcttgaatacgttcgccaattcgagcaacgattcgatcaattccttcgaatagaaatgctgacggatattgatatcgaaaaagcgcaaggcatgactaggcatataagaaagtaaggtacgaagcgtctcacgagattccgcggcacgttgcgccaatgttccgaagcatacggcgtccgcacgtttcatcaaatcgatagacgcttgggtaaaagggatatgatcccatgccacaccttcgatgatcgtataggaagggatgccgttctttagctctaccatcacgcttccggtcggatattccaccgtactgatataattactatcgataccgttcttatccaattcctgaataatctcggttccgaacacgtcgttgcccacggcactgatcgcataaccttccgctcctaattgggtagcgtgatacacaaaattaatcggcgctccaccggctttcttcacttccgggaaaacatcccacaacaattcaccaatgcctactactacaggtttactcttttccatgatatattttgtttttaattatttgaagggataaatggttaatgacgtaaccgtgaacgctcctcccttcgcattgaagctaatgcgattatacggctcttccgggaagactaggttggtcatgacaaactctccattcccgtcgaaggcctctatgctacaattgtctaccaacaaacgtaaggtatattccttagcggcggagatcggggccgaggtagccgtggcgaatgtcttgctaaaatccgtagccccgctgttacggcgatccatcgtgaacgtattatccagaagattataatgcatctccacttcctcacctttcgagttaaacaactggaaactcatgatatcggctccgttattcttaaacttgatctcgatctcataggttcccgtatgatcggaaagtatcggattgacctcatgggaacggtctaccttgaaggttcctttcttctgggctttacctctcaatttcaacatttcgggagacggggtactgctcaaatacgtctgtccgtttttcgtataaagagccaagtcgcgaggaaccgagttcgcgctccggtattgcaaggtcggcacgttattcgcatattcccaattgctcatccaagccaaggcgatcttccggtcctccggagcgttactccaagttaccgtagcgtaatgatccttgccgtaatccatccatttggtcaaggccggagattcattcacgaactgtttcccatcgaacgtacctacgaaatattgggtagcggagccgccaaacggaccgccgggattgatattacagatcaagacccacttcttcaattccgtacccttcaccggaagctcgatcaagtccgggcattcccaaacgcccgcatgcgctccttgtccttccccgaagctgctctcatacgtccagtccttcaaattgggagaagaatagagttgcatctcctgccctacggcgagcaccatgatccatttattggattccttatgccagaagactttcgggtcgcggaaatcacgttgcgtagaagtaaggatcggattccggtcatatttcttgaacgtccggccgttgtccaagctataggccatactctgcacttgccggtcgctggccgaggtatagaaagccacgatagcgccagcgccaaaaccggcggtattatccttatccaccacacagctaccgctgaagatcgtacccaaggcatccggagcgatcgccaccggttgatgctcccaatgaatcaagtccttgctgatcgcatgcccccagtgcatattcccccacatcgagccatacggattgtattgatagaacaaatgatactcaccatccttgtataccatgccgttcggatcattcatccatccccaagccggcgagaaatgataggccggacggaatttctcccggttagacgaatcaaactgatcggatagcttcatctctttccagcaaagagccgattccggggcaagctggaagttgaaggagatatgcttatccgcataccctgatagatctaccggaacgaaataatccaccttattcaccgccaaacgaacattaaaagtccgtaccacgtcattatcgacaatcatatataacttggattccggcgaggactcctcgaccggaagcaacaaatacttggcttgcgcatccacacggacaatgctttgtccttcgcccagatgctttatatctatagtacgttctgtcgcatatccggccaacggatcgacagcgcttaataaaacgacaccgacagccatacataaactcttaagaagtctctttgtttgttgtttcataaacgaacggattaaaggataataatgtttgattctccgccaaaattaataggattcttccggatagaaaaacacttatgccctaaagatggggagatatgacatttgtgataaagatcgtacaaatgttattgatactcggtaggcgtaaccccgtaaaccgccttgaaacatttagagaagtaagcgggtgaggagaaaccggttcggtaagcgacctcactcaccgtatacgcattctgcctcaacaactgggtcgccttattcaagcgataggtacgcaagaactcgacgggggcggttccggtaagctccttgatcttccggtgaaggtgtccccgggataatcccaaggtctcgcttagtttctccacattatattcggggtccgcataaaccgcctcgatctgttccgcaaacttacgcagaaaggcatcatcgatgctctccaccttttccggctcggacagaaggagcttattatcccgcagcttctccaacaaacgttcccgtaacttctggcgctcttgcaataggtggataatcttgatcttcacgtaatccgtatggaaaggcttctgtatataatcgtccgccccgcaggtaatcccgaaaatccgttgacgctcatcggtcaaggcggtcaataagatcaccgggatatggctaaagagaagttgcgacttgatcgtccggcaaagttcgaaaccattcatctccggcatcatcacatcgcttactaccaatgatatctcctcctcttccaatacccgcaaggcatctttcccgtttgcggccgtccggatcttgaaatgaaggctaagctcacgctccagaaacccgcggacctcatcgtcatcctcggtgatcagtatcgtataaggataggtcttggaaagtatctccttggtttccgaatcgtccaaccgggaggcttcgtaggcttgatgggatacggacgtttccatcaggtcgctatcctcgaaatgcgcctttcctttccgtaggcaaaccgtaaaggtagtcctttgtcccggctcgctcttcacatggatctcccctccatgcatatgtatatattcctttaccaattgtaatccgatcccggttcccatcgaccgatcctccgtatagaaacggtcaaacagatgcggaaggttaccgggttggataccacttcccgtatcgataacccgtataaagaccctatcttcctcttctgtcagctctatccgcacgctacctccctctggcgtaaacttaaaagcgttcgagagaagattgactaataccttctccaataagtccggatcaatccatagtgtacattgcttcatcgaagaagtgaatgtataagagatcgcacgtaccgagcccatactgtcaaaataagatttgatctcgccaacgaaaggaaccaaatcgatttcccgtaccgctagtttctcttgcttgccttccaccttccggaaatccaatatctgattgatcacacgcaacaaacggttggcgttcttctggatcagtcctagatccgaggcgtaaggagattcccgcaacgagacaatcaagcgatccaaaggggcgagaatcaaggtcaagggcgtacgtacctcgtgggagacattcgtaaagaattggagtttctgcgccgtcacctctttcatctccgcattcaaggagattagcttacgattcgcctgcctcatcttccggtttatgtaaaaggcataaatggaaagggcgataaaaccaatcatcaataaggagatcacccctaaagagtttcgcaggaaataaaaccggtcggacaaaccgtcgatacgggaacgctgcgcctcgatacgttgcttatatttctggagttggtccgcttgcaacaataaggtgcgggcagactgatgatctaccggagccgtacgaagagggataaacttatccaccggctccccctgaatgatacgcatagccgtgcgaatcacttgctcccctcctgtcggatagaggaaagaggcgttgatccgtccatcttctacggcttccagaccggcacccgccacagcatccacgccgataatccgcaaatcccgtcctcggatggaatcccatgccataaagtattcccgagctgctatggccatcatgtcgttatgggcgtaaacgaaatctatctgctcgggatgctctaacttccgaagctccatccgggccgtatcgaccagccattgtccttctatcttacggaaagaaagatcctccctttctcgcaaggcatcgacaaaacctttatgtcgctcttgcgccggggaggtttgcgtgagtccccatatctctaagataatagcgttcgggggaagataattggcggcgtaattgcctgccgctagtccgatctcataattgttcgccccgacaaaagaggtgtattgatcggtatttaccttgcgatctgtaatgatcgtcgggattccggcacggtacgcttcctcggcaactgccgtgatcggctcggattgatagggggagatgatcaagacatccaccttttggcggatcaagtctcgtatttgttgtatttgtgtctcgttattgttttgcgcgtcctttataataatttccatatcatcatagttagacgcttcgatacgcatatcgttaatcatagcttcccgccaagcatcgtccagcatacattgggagaggccgataacgtgcctcttctgtttccccgagctcgtgcaaccacacaatacgatcaaggttaaccatactagtaaaaagggatgcttcatatacaagaataaaggtctaacgtatttgccacagggctggcacaaccttgccatgcctgtggcacgacagtaccatacggatggcactgccatgtcatcggttaatggcactaattatgcaccagtgtcccgatattctctccgctcatcactttcttcaagttgccgttggtatccatatcgaatacgatgatcgggaggttgttctctttacacatcgtggtagcggtcaagtccattaccttcaggccccgggtatagatctcatcatacgtaatatcggagaacttggtagccgtaggatctttctccggatcagcggtgtaaataccgtccacacgggtacctttcagcatgacatccgcctcgatctcgatgcctctcaaagaagatccggtatccgtagtaaagaacggattacccgtaccgccggacatgattaccacgttgccttgttccagcaactcgatcgcacgccatttattatagaactcgccgatcggttccatacggatagccgtcagtaccttcgccttcacgccttgagcgaccaaagcggagctaagcgccaagctattgatcaccgttgccagcatccccatctggtctccttttacccggtcgaaacctttggaagcgccgctcaacccgcggaaaatattacctccaccgatcacgataccgatctgtacacccatctcggcgatctccttgatctgtgccgcatattcattcaagcgaacctcatcgatcccatattgtttaccacccatcagcgactccccgcttaattttaataagatacgtttgtattgagccatgttttgtatatatttaatatgtaattccgcaaaagtaacgaataatccgatattcgcataaaaaagatcgccccaaccggtgtcggggcgatctaaacactaatcccgtgttttgtaagctgcgaggattagctaaaattatatgaaacgttactggttactttttatctaagatctccaaggtatcggcagcgatcatgaattcctcatccgtaggaacgacgatgatagtcaccttactgtccggagtgctgattaccatctcctcgccacgcatgccctcgttcttctcaacatcgatcttcatgcccatgtattccatgttctcgcaaaccgcacgacgggtcgcccattggttctcaccgacaccaccggtccaaaccaagatatcacaaccacccatagcggcggcataagcgccgatatatttcttgatgcggtagttatatacgttcaaggtcatgatcgcacgcggatttccggcagctacggcagcctcgatctcacgcatatcggaagagattccggaaagaccggcaacaccacttctcttattgatcaagtcggaaaggccggcaccatccatgccttccttatccatgatgaaagacaaagcacccgcatccacgtcgccgcaacgagtacccatcaacagaccctcaaccggagtcaagcccatggaagtatccacgctcttaccattcttgatagcggtgatagaaccaccgttacctacgtgagccgtgataatcttctgatcctcataaggaacacctaagatctcgcaagcacgacgggatacatatcgatgactggttccgtggaagccataacgacgtacgccatatttcttgtacatctcgtaaggcaaaccatacatatacgcataatccggcatggtctggtggaaagccgtatcaaacaccgctacttgaggaatacccgggatcaaagcctccatcgcccgaacacccttcaagttagccgggttatgaagcggagccaaatcagagcactcgattaccttattgattacatcctgattgatcaatacgctagaggcgaactcctcaccaccatgtaccagacgatgacctacagcgtcgatctccttataatccttgatacaaccataagtagagtcggtcaatacgctcaagataaactcgataccttgttgatggccggggatctctctctcgataaccaccttcttgccatccttatccgtcaatttcaggaacgcgcccggcaaaccgattttctcgataccaccttgagccataacctcaccggaggtcatatcgaataacttatatttgatagaactactaccgcagttcaatactagaatcttcatattattaagtcgttaggattatatattattttgcggatttcaaaccgatggattgattacaagcgatcgctaccatcttataaatatcgtctacggaacaaccgcgagacaagtcattcaccggagcggccataccttgaaggataggaccgacagcctcagcgccacccaaacgttgaaccagcttataagcgatattacccacctccaaagtcgggaataccaaaacattcgctttaccggcgatctcgctacccggagctttcttgctacctacagcctcaaccaaagcggcgtcggcctgcaactctccgtcgatcttcaagtccggagccatctccttagccaaacgagtagcctccactaccttgtctaccatctcgtgagaagcgctacccttcgtagagaagctcaacatagccacacgaggctcaacgcctacgatattacgagccgtagcggcggtagcgacagcgatgctagccaactcttccgcgttcgggtttggcataaccgcacaatcggcaaataccaaaataccatcatccccatattgaggagtcttcgtgaacataaggaacgcaccggaaacacacttcatgcccggagccgtcttgataatttgcaaagcaggacgcaatacattacccgtcgtattctcagcgccggcgatctcaccgtcagcgtcacccgccttaatcatcaggcaagccaagaacaaaggatcttcaactaaaaccgcagccttctcggaagtcatacccttcttttggcgaagttggaaaagcaagtctgcatacgcggctttcttctcgtgatttttcggatcgacaagagttgcctcaccgatgtggttcagtccgaaaccagccgccaactccttgatctcagcggggtttccaattaagataatgtctgctacaccgtcggccagtaatcggtcggcagctttaagagttctttcctcggtaccttcgggaagaacaatacgctgcttgtcagctttagcgcgcgcaataatgtcttgcattaaatccatagcggaagatattttatattatttaataattgtactcgtaatccggctacaaaattaggcataatgcaatatagagtttacaaaataggcaaaagaattacaggtagagataccagtttcagatcttttaacagtaattcgtcacttcccgctccccggagagtatttgttgcagttcttccgctgtcacattcacacttaacttacctttatgggccacggagatctttcctctctcctccgagacaataataaccagcgcatctgtctccaatgacatccctaaaccagaacgatggcgcaatcccatatccttgggaagggtagcgttctgggcgaccggcaagatacaaccggccgccttgatccggttatcggctatgatcatggcaccatcatgcaacgggctgttcttaaagaagatgttctcgatcaagcgggcatttacatcggcgttgaacatctcgcccgtatgctcatagatcgccaagtccatatcttgctggatcacgatcaaggcacccgtctttttccgggccatattcatacaggccaagacaactggggcgacaaacttcccttctttctccggatcgcctcctcgcttggaaaaaagtttccctaggaatttccagccccggtgcgaacctaacgccaacaggaaacggcggatctcgtcttggaagaggattaccaaaaccacgaaacctacgctaataaacttatccaagatggcccccatcaaccgcatctccaatacctgcgagatcaagatccatacgacgatgaatgatacgactccactgaatatagccaatgtgcccgagcttttcatcaacttataggtctggtacaggaagaaagccaccagcaatacgtcaatcaagtcttttataccgaaatgcatccacatagttaattgagaattgaaagttgaaaattgaaaattatttgttggtcatttgacctatgacgcgaatggcttccactgcttcccgcacatcatgtacacgaaggatattagcgccgttcaagagagcgtacgtattcaatacagtcgttccgttcaggctatccgcaggggttccacccagtaatttataaatcatgcttttacgggagactccaactaataaaggcaactcaaaaatagagaactcctttaaatggctcatcaattcgtaattctgctccaacgtcttactaaagccaaagccgggatcgaggatgatatcattcacccctaaaagccgaagctggcgtaccttccgggaaaagtacagcatgatctcctccatcatatccgggtaatcagtatgcctctgcatagtttgaggggttccacgcatatgcatcatgatataaggcaccttcaaatccgctaccgtttggaacatatccgcatccaactcaccgccggagatatcgttaatgacagccactccatattcctctacgcaacgacgggcaatccccgcacgaaacgtatctacggacaccgggatatccgggtaatgcttatttaatatatgtaaggcaaactccaaacggcgcatctcttcctccggcgtaacctcagcggcatccggacgggatgaataaccaccgatatcgatccaatcccctccctccgataagatttcccggatacggtcctcgatagcggtctcggtctgtttgcggctgcccgcataaaaagaatcaggggtaatattcaagattcccatcaccaacggtgtcgctaaagaagtaagtgtccctctaatattgagcattttatctaacatgatctttccttatttccagcaaagatacaggtttctctcttaaaatctccttctagattcttcattctttatttaattgctacatttgcgccgaattagacaggaataaatatttaacgcgatacagtcatgagtattatcgacctctatgatttatttatacataaccctcaaataacgacagatagccggaactgtccgaagggttctatcttcttcgccttaaaaggtgataaattcgacggaaatcaatatgccgggaaagccttggcatccggctgtgtctatgccgtcatagacaatcccgattattatataggcgaacgcacgatccttgttgataacgtgctgaagaccttgcaacaattagcgcaccatcaccgcaaggtactggggttgccgatcatcgggattaccggaacgaatggcaagaccacgaccaaagagttattggccgccgtgctctcaacgaaattcaatttactatataccgaagggaatttcaataaccatattggcgttcccttgaccctgctccgattgactcatgaccatgagatggcggttatcgagatgggcgccagccatccgggagacatcaaggaattagtggatatcgtccatcctaactatggcatcatcacgaacgtaggccgtgcccatctggaaggcttcggttctttcgagggtgtgatccggacaaaaggggagttatatgattatatccgtcgctccaaaggcaagatatttatcaagaaagagaacgagtaccttcagtctatcgccaaaggcatcgaacaaatcacatatggaaacggggatgatgctttcgcatccggacaggtagtcagttgcgatcctttcttagtgttcaattggaagcaacaaggaaagttgcataccgtcgaaacacatatgatcggtagttataacctagataatgtattggccgccgtcgccgtaggccgcttcttcaagatcccggcagagcgtatcagccgtgctatcgccgcttacgagcctaccaataaccgttctcagttcaagaaaaccgataataacgaattgattatcgatgcttacaacgcaaatccgagtagcatgaaagtagctctggacaatttcatcaccatgcccgtacagcctaaagctatcatccttggagatatgcgcgagcttggaccaactagcgacgaattacacgcagaggttgtcgaacagatcaagaaaggccagttcgacaaggtgttcctctgcggcgagcatttctccaaggtaggcaaagagttctcccccttcgctaccacggaggcaatggtggaagagcttcggaaacagccgttaaagggctatcatatcttgatcaaaggctctcatagcatggggctggagaaactagcggatatcctataagctatcatcgaacaagacggttttcaacttctggtacaagaaggagagaatcaataagataactcccaagattataaagacgaccaccttcccgatcgtaggcaagagccacagatccaccatcaccaactttagcaatacgatcgagaaggtggccaaactaatcatccggacaactttcagatgcaatcgcattcccaccgccatttgcataaaaccggcaagactcaacgagatagagaaacctgcgcttaattcatccggcaagcccaactgattcaacaaattattcgttcccacggctagtaatatcgtagacagcaaacaaatatataaggtcatcccatgcgtacgcttttctcttgcgtcaaatgacttataatagtaccgccccaagacaaaaatatgccccccgattaaaagcaaggaaacccatagcaggaaccggggaataaagagatcatcatacccgacccacaaagacattcctccgaacagggataaagatagccccaagagtagtccgtatccccccgcatttcttgacacaggcaaatagcttttccctaataaaacattcgcagcaaataaaaccgccaccgtaaatgtctcgatatagctaaaggacacgatcgaaggatctacatatgaatagaaatcgaaaacaaaggctatatataatacgacacatcccgtcaagagaggccctttcgtcgagatccttgtcggacgtaccaaccaagcgtctacccaatacgatagccccgtaaaaataccggtagcgaacaagccatttataaatagggaagaatctccgtaccgagcctccatacatccgtggaagacatccattccgtaagagcccagcgtcaagaccggaagtacccaaacgaatatctcgtaaacccgcagacggaaacgactatagaaccagagaataatcattacctctgaagcccaaaacaaggtaataaaggtcccttccagttggatcgggatcgtcaccgatacgaacgtaagagcgatacccaataacgtatgcatcaagaaagtgaaaggttcccctttccgtttgatccaaaagaaaagagcgaagttaatagccgcaacaaaaagggttaccagacctttgtaattccgctcaagctccatattctgcaggagacaaagggcaaagaacaggaatacgaaattgttcaatccgatcactcctaataaatattgattgatcccccggatattgattcgcacgatggaagcgaccgataataagaagatcaaatagaaggcgatagagaaaataagtaaatgcgttaattggacacttcccatcaaatccagatccgcagcatacgtataacccgcaaagacgatccaagtcaaggcaaaacaaattacaggcaattccccccacttcttatagatagatagcccgaacatccctaggtccaagatcatgacataggtaaacagcacccaataacttccatccccgctgcccactaagaatggagcgataaatccacccaccaaagcgataatcgccagttccctacgattatagagtatagataaagacgacataaacccggtaaacaatacaagcaagataaaagcgaccgtttggctgaacagcccgtaataatgataggcgatcgccaccgttacataaaagatcgcaaaagcgcctcccgccagcaaagagctaaaggtacgataggaatccttcaaacgccaagccacgaatagaagtaatccgcccatcccaaagccaaggatcgtacgcaaggtctcgtttatccattccttatctatcgcatacttcacgaaaagacccatgcccaagacgagtatcaggataccgattttaccgaataagttctcaccgatatatttctcataattgacaggcttccgttccttccggggttgaagatttctcgctggttcgacaatcgcccttaccggttcaggttgtacgaaaacttccgactctttcaagatctcaggctccggttcctttatctcgtccgcaacttccgaactattctccaaacgtctacgcaaggcagcgatctctttcgataattcctccgtcttctcctgtgatttggatatcttattacgcaagtttatccaaatcatgatcagtaatagaagtatcagtaaggtatattccataaactctaaaattataagcttaccgcaatatacgcatttatttatataaaagctttccgaaccataaaaaagtcccgacgatacgaatatcgccgggagcaattttttatccggtttccttcctcacggaaatactatcggaagaacttttttactttagtattaaccacacgttcccccatcacgggatactttgttgtgtggaaattatttaattaaatatatttagatagagacgggacgtgcccgcctctactgtatcatttcgaataaaataattatttaacaaccaccttaacagcagcctcaccctctacagctacagctacgataccggcaggtacagcgattgtagcgttatcagatgaaagaactgtctcagcaaccaccttacctaagatgttagagataacaacagacttgccagcggcaccttggattgttacagtaccatcgttagcgataacagagatagcagactcagcagcgatcttgtcattagatgtaggagtgctagttgtcattaccttgaatacttctgcttgctcaggatcagttgtccaataaacaacattgttcaaatgagccaaataagcattacgaggtaaatatttctctacatcatactcttcaccttgctcttcagctgcttcctcatcataagccggattcaaatattcttgaacagaaaggatcttgtaagcctcatcgctatactcagctgcgacctcaaatgcgacagcagccggattcaagttcatcgcattgattgtatcacccttgattgcgatagaatctataccgcatacagaaccagcgataaatgcagcacgaacagcctcagcgccagcagcctcataagcataacccttaacctctgcagaatccaatgtattcatcaaatagtttctagttttcacaccttcttccgcaaatgcattagtagaaagataatacaaaggcatagtctcttcgaaagtcaagcaagcagtatccaaccacaaagtcaaagaatcatgcgtatatacatcgctcttcaagatagactgtccttctgccttcaatacagcgaaaccatctttctggctagcgatcatcttgttatcatcctctgtataagaagtgatctgtacgtgaccgatattcaaagtagcatatgtaggagcatccttctttgcgaactcgaatgtagtattctcagtgttgcaccagctagctgtatatagcattccagatccagctaaagcagagattgcagaaccataataaccatattcttcagtatattcagaataagaaaccaacttatattcattctctacaccagtagataagaaagataatgtaacaggataaacaccattctctacatcaggctcacccattaaataataatcagttccattttcatttttagagcataaagtagccttacctaaacgatctgttacattatacttgtaaactttcactccatttgactcagctacagttgaatttgcctcatctaattcaacctcttctaccttaaatctataagcagaagccaactcaccggcagctacatacaatttgccatctttaacagttacatacaagttctccaataaatcagatttcaaacggaatgacaatgcaccattaaccaaatcttctttagaaactttcttataagctaactcttgagcatcctccactttcgggccttttaccaattgaactgtatctgttccaaaagaataaatagccttcgcatcatctattacgcggataatagcaccacctctagtactattagtattccacatattagccaaattattagtctcagtcaaataccataaagcagtaggaacttctgttacagcaccagcatgaactgtaccgttctcacagaaagagaatacatagtattttcctttgttcttatttgcggaatgatcctcatcagacttcgcattgttcatatccttaacaaagtaagtatactctggatccaatgtagtcggaagcttaacctcagcgaaagtacatttagcagcatccttagtccagattgtcaatttctctgtacctgcgaagttaccaaaagcgatcatctcaccattagcggcaacctccatgtcataacacatttttgacttcttctccgtatcatttgcgcctttatatacaggagtagcatacggataaaggatcatcttgctattatcggaaggatctaaaaccaccttgaaagcatacaactctttcgcacgaccattctctaggatcgtaccagctgttacaccggtagccttatcagcagcagcagcctcatctttaggttgtgcgtctacagtaagtttccagaatttctcagaagacaaattagaagaccaagaagtagagtccacaactaaatacttaccggtagttctatcctgcaaagtaacataaccatctaaaccgtcaatgtctgtagcgaacaactctttgcctgccaaaggatttccatccagatttttgtcgaaagtcaaagcgaaaggagaaccatacttattatttaacaagtcagcagtcatgtttatctttgctggagctgctactgtaaagttaatcgcagatgcagatacagccgttcccttttccaaagtaacaatatctgttctttcagcttccacatcatctttagcgatgatagaaacaactgtcttattatccaactgagcagataaagtaacggcagtcacattctccggagcgataaacgcaccctcatttttgaagttccactcagcttgcttatccaatgtcaacactctgcctgtagcgctattcgtcaatgtgtacgcccaagtattcgccaaagagacaaaacgataagttactttccataaggatttttgataatcagtgttcttgatatccgcagtaggagcatcagccaagatcaaactatcagtctttgtataagactctgtgacagacaaatatttaccatcctcattggtcaattggtaaactttgccattttcaaccttcgcattagcggtaaaggcagtacataaagccaagcccgctacaagagtagaaaactttttgttcataattctaaaattaatattaatactagtgttaattaaaagctctttatatatgcatcccacctaaatgggtacaaaacgactagtctaaacgatcgtttaaactagtcgttttataaacctatcttcatacgatcaatagcatatactatattttcaatagaatttacccttttatcatatattatatatgtacgagcgtacatatataatataattatcaagcaatcaacagatattccttattccttcaagtcttataataatgaaacttttgttcacctatgaagtaactttagttccataagcttaaaactatagcttgatgccgatgcaactaaagtcacaagggcaaaacgcctctttcatgcttttattggtcaaaaaagagagtaatctatgtatttgaaagcttttttcataaatttgtcgctttataataaactgagtaaaaaatgaatacacacgaactttgctgcgtaggacacatcaccttggataaggtagtaacacctaagaacaccgtccatatgccgggaggaacctccttttatttctcgcatgcgataaaacatttcgatgatatcgactatactctagtgacagccttggctgaatctgagatgaaaacggtggaggaactacgagccgaaggtatcgacgttgccgtgatgccaagtaagcacaccgtttatttcgagaatatttatggagagaaccaagataaccgtacgcaacgtgtattggcgaaagcagatcctttcaccgtggaatatctggagaacatcaactctaaaatcttccaccttggtagtttgcttgccgatgatttctctttggaagtggtaaagtatttagcggggaaaggcttagtatcgattgactcgcaagggtatctacgggaagtaagagacaaggatgtatttgccgtggattggccagagaaaaaagaagtacttaaatacgtgcacttcctcaaggctaacgaacatgagatggaggtgttaaccggatataccgatgccgtgaacgcaggaaaagttatctacgattggggcgtgaaagaggtattgctgactttcggaagcatgggatctatcatttacgacggttccactttccataaaatccccgcttacataccgaaagaagtagtaaacgctaccggagcgggtgatacttatatgacaggatatctctataaacgtgccaaaggcgcaagcatagaagaagccggacgtttcgcggcagctatgacaacattgaaaatcgaaggaataggcccattcaacggcactaaggaagatgtgttgcgatgcttagagacagcggaacaacgaatgcctgagtagttgaaaattgagaattgaaaattattcgctctctcctaattttcaattctcaattctctatctttaattattcttgaatgctttgcagaatgtagtcattagcaagatacaaagccctaacaagccgaccacgatataagcgtatttcatattgaaagcctgcgagatcgctccgatcaacaaaggtgcgatcaacgagccgataaagctgatactggaaaggatcgtcaaggcaattcccaccggagttctcgatttagcgcccactaagctataaatagtaggcaccatacacgagatgcccaagcctaccaacataaagcctaaggaattcacgatcacctttaccgtcatcgattcgaacattccacccaacatggctgagataaaaaaacctgctaaaataaagaaacccgctaattgcaacaccttctgctttcctaaaacactataggcggagttcgtaagaaaacggcctaccgtcatcatcaccatgaacaccaagaaaccaatctgtaaggacttaggaacctgcaataccgattcgaagtaaagtccactccaatcaaacatcgcgctttccaccaccaaggcaaacagcccgacgatacctaactggatcaacagcatttccggcttacggataaagctcaacaatgccggagcttctttcttctccgcttccttctcttcctccggtgactcaaccgccacgtcttcctgcaaatacttccggcttaccaaaacagtcactccaatcaataatgcaatcaacgtaaaatgccagaacggagtaacaccggatacgatcatgataaacccgatcaaagcccctaaacaagccgccagactccaacctccatgaaatgaggccataatcgtacgcccatagagtcgctcgataccaattccttgcgtattcaaggatatatcgcaaagattccagaacaccccaaaacagaacaaataaacacccagcagataaatattatgtgccgtacctatcgcgaataaggccaaggcataccccaacacactgacctgcgccataatacgactccccaacttcgacaccaaataacccgctaacggtatcgccacaaacttacctaccgggatcaggaacaagaccaagccccaatagaaagcgtaattcacctcaaaaatatccttcacgtccggaatacggctagcccaactagagaaacaaagaccttgcgctaaaaagaaagaaagcatcgcataacgaatccgttccttgggaaaagcgttgcccaatgtagcattcattttttcattcattatcatttacttttattgttatcatttattcgagaaaggggcacgccccccatttcttcgcaaagctatcaaatatatcctaatatcctaatcccctaagtcttaaatgtagaatttaagagatggcttccctaatgaaaaatatattttacactttggctgaaacacttaattataacttaaaccttcgctcaattgaacaatttgacgatattctccagcaacccatacgttgtcgttttccttgaatacggtttgggatggaggattcatcattgactttccgtctcgttcaatacccaagatcagacaagcgttcttatcccgaatgtcagactgttgaatagatcgcccgatcaacggagagtctggttcaatattaaattgctctattttgatattattattaaagctttgcgccaactgatctctatattctttgtcctgtttttgtattatctcctggaaaagatccaattcctcatccgtaccaacaattataatcttatcaaaaggataaaggcgttcctctcctctaggtatattgatttgtcgttcacctcgaatgatggaaacgatatttattccatatttttgacggaagttgatctctttcaaactccggccgacaatggaggattcttggccaacaacgaaatccatcaagtgcaaatcattgaaaggcaaagatttcaagatattatcagtcaaaggacttccaatgtttgagtccgttgttttcccgttgaagttgtcaataaatcttttctcgatcgagagagaacgctttttcagttttttggataaaataatcattagcaatatcaacagggtgataataaatccaacaccagatgctacattaaatatatggactatgactggcattagaatacttgcgcaaaggagcagctttatcgctatcaaagaaaccaatggtccccggttgaatttactatcattccataatttcaggaattcaggagaatgattcttcttcataatgatagcccaaagaaaaggtaatataatggccaaaataatagataagctcaatagagcccctttgaagcctaatatgttctcgcgaataattggatttacataagtgaaaaatatgataatactgaatattgtcaatactgtatatagtattacatctagtaacatagatttcaacagcttattccatgtacttttatgtttgaccgtgttggatccggaagaataacggttcaacattagttttatagatgaaggcaaataattgtcaatcaattgatagaccggggtcgccatgcgaatcatataaggagtaagaaatgttgtaacgactgatacagcgacaataacaggatacagataatcgtctgttacctttaagctaactcccaatgaagcgataataaacgcaaattcacctatttgggtcagagagaatcctgattgtagagctatctttaatggctgtccggacaagaggacaccaagactcccaaaaaagatttgcccaatgataaccaatatggttaagatgcagattgggacaaggtattcaatcaataaatccggttgtatcatcatgcctacagaaacaaaaaatatggccgcaaacaggtcttttaccggttttaccaatttttctatcttctcggcctcaatggtttcagccaataacgatcccataacaaaagctcctaacgcagaggagaatcccgctttagccgcaatcataaccatacctaaacagaagcctaatgctatgattaataaggtttcgtcgttaagaaatggcttaatctttttaagaaaacttggaatcagatagattccgagtaatgaccaaaatataagaaacgctcctaactttagaatactttccagcatttccattccttcgacttgcttgctgactgctaaggttgaaagcaagaccatcaaaactacggccactaaatcttcgaccaccaagacgcctaatactactcctgtaaatttttgccctctgagtcccatgtcatcgaacgccttgaatacgatagcggtggatgacatagaaagcataccgcctaaaaatatactgcttagatgcgagaagccaagcgcgtttcctgcagtatagcctagaaacatcattccggagactatggttatagaggcgataacagctgtacctcctacggtcatcaacttcttgaaagagaattctaatcccatagcaaacaaaagaaagatgacgcctatatctgcccatatttttatattggtaggatcggataccgttggtatataaggtacggcgggcccggcaagaatgccagcgacaatataccccaaaacgacaggttgtttcaagcatttaaaaatcaatgtaattattcccgccgcaatcaatataaccgccaagtcggaaataagaggtgcaatttcagacatgttattcattattttgtgctcgcaaatttacatattaacttagaaccatgttgggataaaacaaaagtactcttgtcctaaaaacatatatgggaaatattccaggacaaccgcagcaaattcctcctccccccaagagctttatcttaacagcatgaatacaccaatatctataagcggcagtttacgagatataaaaaaagggtcttcattgctgaataccctttcttggtgatccgcctgggattctcctaagagagttaccacgctgatatttaaaactttatatttttagcttcaagcatatcccatgatttatcccactgatttgctacgtgcttttgcggtagtttgctcatggagaatactgggacaaagataacaagatctcattcttattgcaaatttgttgcagaatttatcacttaattaaatcttaaactgagtttaataggtagcagttcctaaatcgctttgtgtaagtttagataaatcaattaatccatcagtgttctttctccaacgtcttctaacatagttttcaaaagttccttgtttaagttccaaattatctgcatggtcggaaattattacttgtggagctatctcaaattctttatatgtatcatttatgaattttaaaatctgatcaaataaatttgtgactgcttttaaatcatcatctgtattctttaaatcaccctccatttcttttagtttgtgaggatcaaaaccatctttgttattatcgacaattgttggaaaatagacttgacttggctgatctaggaataagatacttggaactaagcacttattccctaatgaacagaagtacttctgaataccaaggaaaaggcaaacatgtgaatatagccaattagctccacttcccattgatctaaggtagattttcttttctatttgttctgcctcattctttttcagatgatataactcaaatgtattaatgtcaaattttaagtttatttgtttgtatgatttttcaaagtcaaaattcttgccgatttcattcatagcttcattgatgaaattttcagccgattttaatttgttttcaacatcatactcgtcacttattttcctttccaatgtatcaatatcttccttaagctgttctatgtttgattcttgaattttattttttatatccaacgaccattcaagatggttttctattgataaacgaactttaaatccttgctcttctaatgatttatttttctctaactcatcattgacttttaatattttatttatttcatatcgaatgtgtttaagcgtttcatcaatagcagctaattcttgttcgcatttttgtttttcaggcaaaaacgaatcaatcattaaaggagctttacgtagctctgaatttaaccaatcaatagcatctgatagcttattgatttgaagagaggtattattatttccttgtaaacagaatggacattgagaatcttcttttatcgcttctgaaataggggttatcatatcaattgcttcactgtatttttttgcatatttaatagatgaattgatgttttccaatttcaacattatcttccgccgtgacgcaagaagttcgtttttacgtgtttcaagttttgtatattgttctttgaagacattagactgatcatcaactgttatacctccatcactttgaattttctctaaatatattttgggagcttctagcatattttcagcagaatacccttgtaataggtgattcccaactatcatgtgatattcttccaataactcccttagtattgcagaccttttctttttctcatctttaaattgagtgatttctcgttgcttcttctcgtactctaactttttatcattgatttgttgtttaataataaaatagtcttgatctacaaaacctgcaaatatcttaaattcatctataatcttgtctcttttttctttctcatcgaatcgataaaataaagaatgcttatttgcaataagattttgatgttgaagaatatacgaggtcatgtttctaacagaaggacgtccctttttattgcggtaatttaaaatattgttatcttcatcagttgatgaaatatttattccaaaatatcttcctaactcttctttgtaggcttttagtggaagataataatctgactggaaatattctgattttaaataatcgggcgatggaaaattgggatcaactcggaagaaggcgtaagtacttttttcttcttgatttcgagccaatactaaattcgtattattgatctcaaaaacaagaaaatacaattttgtattatcggttatcaccccatctggtattgtgttttcggaattaccaaagcagaaatcaaatatttcaataatagcacttttacctgtagaagaacgtcctgtgattatgtttaatccctcaataagatcaatataatgacaattttcttcgttatctattaaaccgatatattttatataacttttcataagcctttaattccaaatgtataatatgtattaattatatcttgcgtaaatatttttggtagttttgatgcaaggtttatggcatcattaaatgatttatcagtatataagatatccctattggtcacttttatacttagattttcatttatttcaatatacttgcaatccaaagcatattgtaagcagtcgttagtaatctgctgaaattgcttgaatctattctggaatcctgccattatctttttatttgctaccaatcgtgttatatttgaatttctattaacactttttatttcttcaatagcaattggatttagcactatcggaagaatgaaataagcaattaatatatctttttctcttgatgtataatttttgtagaaagaaattattattggagttagagaaaagacattgttatgtataagaaatatattatcaacaaacttactcatgtttttagttttataagccaaacaaaatcttctttttcatctgctaaaatgtgtaacattccattatgaaagtaagctggaacactattatatatataaaaagtactatcattagcagacatcatattgtcatagaagtcttgagaatgaataattttatgtctattgtcagaacagtgcctacaggcttttcggtattctgtattatgtctctttaagagagtttcttcatattcatttaatgaatcagaaattttctttgatgttatgatttcatttattattagttctttagtttgtacataatctgttattgcttccaatactacttcattgtattcaatctgtttgattttatcaacgaacgggtttgtattgtattcttcgtgttttatatctatcaaccttattttagaaggaaaatgagtcgtcgtatcaattagactttgagcgagtatatttacttcttgcctaaaatcatcatatgtaatactccaattattatcaattgtttgaggcgaaattacatatcctaacatggagcgaataaattcatcttggcgtatttctggaattgttttagcatgagtttcttttatgtatttgtaatatttaatatcattcaaggcattgttatcaatcacaaatttcttcaatgcaatttttaatctttcaaatttagcctcatttaatactgattgaatcagcttttctgtcttagcatccttacttgacttttttctatagtattttaatgctgcattttgtaatatttgtaacttttcagcgatatttttatcattccatccaaacctgatacttgttgatttaacgttttgcgtagtcaataaaaccaaagaagagaaagaatcaataggaaaactctccttaagccagttattcaaagtattccatatattatgatcataatcggtcagattctctttataaaatttagattctatttgtactgtgtcgttacaacccaaaatagatatatcaccatatgtttctatatatacagtttctccagcttgtaactcgaagcattttcctaaagctacaagaaattgataaattaatccttttattgtaggtgttgaattattacttagtttcaccatatctacaaattattttacatctgcatttatactaactacagtgtatgcaaatataatatcttttcttcacatatttagatactttaggtataatctttagactatcaatacatttgctaccttatccttcttcttttttcccttttgctctttttaggattagataaaagttcttctggattggaaaaagaacttaccttcgttggagtaaatgaaatgagtgaactagatattgggctattttggagggttatagggattttagtttctagctttgtagaaatattagtatttgtattgtcttctaaattactattttgtttaatttctgtttttctttcattaggttccaatttttgttcttgtaatttgagttgctcatatataggattattcttcatagtgttttgataatcaaatgcttctattttctgacggttgtaactaaataacttatcaaacccctgttctatctgctgaaacagattcacacggtcaaagccaccttttattattccgttctttgtattcttatgattggtgagtggtgatagtttctttttattagtttggtcttttcggctcacaatcaaatggcagtgcatattcagttcattgtcggaacggctacggtcaaaatgtatctttccgtaaaactttatatctgcttcggatagttctttgttgaagttcttggcatattcagggataaacacctcacgaatatagcatttcattgcttcggcttgttcctgttctgtgttacccatcgcccggagttccttttccgatgggctgatgtgaatagcgtaaaacttagcatccgtttttaggagttgcccaatatttgtatctatatcctttatgacctttgatttatagatattatcatctgtaagattgaaaaagccttcagtatagatgcctttctccatccgttctaaatcttcatgctccatgtaattagctagctgtcggctactaccagtgttattatatgttccgtttgatggtggggcaaagtctatgtgcattatcctatgtgtttatcaaattgctgatttctgctttcaggttctctttccttttgctatccatcaccccacaagcagaaagttccgaatagagttgtattaggtggaacagttttttataatcccgttggtgtatctggtaaagtgcgttaatctgtttggactgactgtttattacatcggcatgattgcagaactgctcacttagttttttaagtacagctgtttgtttctcctgactggcttccaattgagagagaataagagtttctaaagttttgccgatagcatcgaaacgcaaagcgatagaatttgttactcgtatcatggggttcagttgttcttcctcatagtgacggatgaagcggataatatcatcctgtctcttatttattttcgccagttccgattttactgattcaggggcttcggatgggttgatatgtgccttatctatatacccgaacgccaactttacaacttcactctttttcagtgaatagcgtttgcatatcttctctaccaaagctgccgtttccttgtctatggaaacggtagtgaatatcgtttttcgactgttgtttggcatggtaattacttttttatagaaatatgaatagataaatacctgataataagcattacaaagaaaatgcttattacaggtgtcattacagcgtgttcttgtaacacgctaaagccgaaggctttgccccgcagggcaagagggaagaacaggacttgtccagttccctcttgctcgatttagcgaaacgggctgaaccgataggtgaagcagtttttgttaaatcgaggtgacaacacaaagaaatagcccgtacacaggcttcttccttctactgcattttgctatcagggctgatttgtcaactgattgtctttttcaaaccgtttgtaggtttgaaaatcggcacgttcacgaacaaaagttcgaatatctacagcccgataataggttttccttccgatagtgaaataaggaagttgattatttactctgtagcgttgaagagttcggaaagatactttcaggagaaaagctaaatcctgattatcaagaatcttctcattatcatctagtactgtatcagtattgataagagatttcaaatcttgtccgattacggtgagttttttggatagtttctccatccatttcttgaaattttcgttatctatatacattttgcttcattttttagtttaacattattgttctcaatcgattgatgaagcaaagtacggtaaatggatgcaaataagttaggggtgtagtatatctactcccctaacaattgttggtaagttcctgatttatagatagcctttctttttactttcttcggcaatagctttgcgaagtgtatccaaaaattcgattcgtttattggcttgccgacaaattacactttcatgctttttgtggatgtccccaaatttgatattgaagagatgttcaaaggctcgtccgatttctgttaatggtgcttctttcccggcatggtttataattctcttagataggaataatccgctaactagttccatgatttcaacaaggttagtttcatctgtcagatagagtggcgattgtggattaccatttttccggttttgaaatggggttggatattgaatttttaggttcaatagctccagttctgaattgataatagccaatgtcttttgtagaaactgttttttaagcacattttcccccctgcccataaagaggtacagtttcaagtgaagctatctcaatacgggtagctacaagaatccggaaagtagtggagtaatcatttccattactcatggctctaatttgttcgacaaattcaccataggcattttgcatttcttcggttgttacttcttgtgaggtttcaaataataaatcactcaacctcgttttcaataaatcattcatatatctaatatttataaagtgaaaaatatcatttatgcacaatattttttaggcgtgatttattgctttttgaatctattccttttgataatacttttctcttctaatttcataaaataaagaaggtgttttaccattataaattaaatcatcaatatatttgagtcctaacctattcatcattttgatagaacggttattggcagagtgtgtgtatgctacaatccgattgaaatcagctatactaaaggcatgtgcaattattacttgtgcagcttcagttgcatatccgtttccccatgcggaatatttcaaccgccagccaatttcagtagcctgtctatcatcttttactggtaatagatgtatccaaccaaggaaatttattgggttttctttcgaaaaaatagaccaatatcctaagccagaggggtaggatttcaaaattctctcttttagaaaggtaagatgttcgtatgaaccgttccattcccccggtatatattctgtaacctgtggagctatgtccatctctatacaactttcgagatcgtctatagttcggggcttgagaatcagacgaactgtttcaaatgttggaagcataacacttataacctttttatcatttcaaattgttttcctgccggttctatatttttcgattgaagaaaagttgtaattgaatgacattctatgtcggtattaatgatcttaatagaactatgtttattgctttcgagcatcttctgaaaaagcaatgaaccaactcccctgcggcggaattgtttatcaacagctatttgagtaacatccccagagataggttcaaaaactccatagccgataagattgccttcagaaaaaacgcctaaacaaataaagtcttttaagcatctctctatcgcttctatactattctgccacgagggtttgaaatcccaaaagttgggtattgaattatattcatcaattttaattggcttcaatgtataagggaaatcaagcgttctaatagtcttgctaatctgattattttttaacttgaagtaataaaactctcgtgtcacctcgaagcctaatttcctataaacggagagtgcacctatattatgcagtaatacttctaatagatattcctttactcctaatgcttttaaatggggaattgaatatttaaaaacctgcgtagccaacccttttccctggtagtctttcagtgttcctgtcccagtatcgtaagcagttggtgttccatagaaattccctatcccattacacgtaaacgaaactattttatttccatcaaatgctccaaaagaggctttgggttcaaagccacgccgttttagcatagttaaaagctctactttgtttaactgcacttcataatcggcaaaagcctgttcaaatgcctcaaataattcattaagacatatattatttaaagatcttatttccatattcatactactttatttacttttttgcaaaagtagtgaaatggtatataatagttcattgacctatgttaagagatttaagtcggctcaatgattctggtttaattccgagataagcggcaatataatactgagataggtgttgttctatttgcggataggtttttagcaataatttatatctttcaaatgcactatccattaggaaagaagtttccttcctgcatttcttaatcaacaagctatcagaaatatattttccaaatttaaaccattcgttcgattcttcgagtaattgattgtaggctgaactggaaagtgtgacaagatgggtgtcttccaaagcctgtatgcttccgatactaggctcaccagtaaggaaacttttgtaagaaacgacaattgaaccggaaaagtaaaagtctttaatgaactcaatagcatctttctcaatataggaacgtaacacaccactttcgattataccaagattataacaaactttgccctgttggacaaacatctctttcttcttcaaatatttagtttctgccaattcaagaaacctatcgcacatatcgttcgatagatttagttcttttttcagtatttgttcaacaacgttcatttgtttatcaaataatattatactataactcaatgatatcaaaggtaataataatctttgatatcattaatagtctttcctataaaacaagactattttagataaatctaaatatttcaactaacaagatcgcttttgatttgagtaatagtgattctgtatttcatgatatgagttatctgaacagactatggaaattgatttatttctatatcggttatttatacttagcttattgtcaataacagtcactttataccacttccagacagtttttaaaacgtctcttgattcttctttcatttgccgatgaaaatagaatcaacacgttttataaaccatttaaaagagaaagtatggaagtagtaaccattgaaaagagaaccttttcgtatgtctgcgaacggttcaccgagtttgccaaacgaatagaaagtttgtgcagcactcatacccagaaagtagaaaactggctggatagtcaagaagtgtgcctgttgttgggttttagcaaacgaacactgcaatattaccgaagtagtggacggctggcttattctcaaatcggaagcaagatttattataagtcttccgatattgaaagaattattgcggacagtgaaacacaaaattaatcactcaaacaaaccacattttatgaaaagagctaaagaagattacccgtccttcaatctgttttccattgttggcacatgggaaagcgttaatctgaatcctacgataatcctttatcggagcgataaagagtaccttctttctattatatatgtatcggaaaccactaaacaagcttcacccgctacttatgagatacagcaagatggtagccagtattttattgccactgcatccaaacgactctatgtagattatgattcggcaaaagatgtacttagcatttcatcgctgggtgactatctgggtgactatctgcgtaactagccagctatctagccatcttgaaatcaatatttcaataaaacaatctttcaatcatggaactaataaataaagataccccacaagtcaaagaatttatttcttcgcttgattcgatgctgaacggtattgaatctatagtcaagcattacaagccacacctgaacggggagcgttttctttctaacaatgaagtttccaagaaactgaatgtcagtttgcgaaccctgcaagaatggcgagatacagggctaatcccctttatccagataaaaggtaaaatcatctaccgtcagagtgatattgataaactgctccaaaaacactactttgaaagttggaaagagtaacctgccaagcccaaaacattgtttttcggaatttaatttgaatcattgacttttccagtgaagtatttagtctgtgcaagtctttagatgaaaatacgctcgaacatagtgagaggaagattttcatctaaaccgaaggctcggacttgaacaggctaaatacggaacttacctttgtcaatgcttcatattgagttctggaaaacttactatgaaagaaaaggattgagaaaatgaaattcattcttcccaatcctttttcaatattagctactatctttattatatagccaattccgacaggcagctatttactttttgcatatccttgaaaatattctgatccaatacccttgcatagtgttttgttacgcttgtatctgcatgacctaacatcttagcaacattctccatactcacgccatttgcaaggcaaatgcttgtggcatagctatgacgggcggtatgagtgctaagatttttatgaattccgcacacatcggcaatctccttcaaataactgttcatgcgttgattacacaatacaggtaaaagttttccggtacactctactacatccttatatttatcaagtatagaagctgccacaggcagcacaggaatgttacacatgatttttgtcttttgccggttcttccttatccaaagttcccctttattgtcttttaccaagtgttcaggcgataaatctttcacatcgctgaacgccaagcctgtaaaaatgcagaatacaaaaacatcccgtacctgttctactcgtttaatggtgaactctttggcaagaatgattttaatctcgtccatcgtcagaaattcaggatcggtttcttccagtttgaagcgatagtaggcaaacggatctttttttatccagtcgttttctaaagcaatacgaataatcttcttcaagttctttagtcgggtgatagctgagttctgcgcacaacccttttcaatcttcaagaaagcatcgaacttagaaatgaagttcgcttccaagttattcagagcaatatccgatagctgatattctttcttaatgaattcctccaaatatcgggtagtggtttcataccgttgaacagtcttgcttacaaagtctttgccgatcagcttacgactttgttcattatgttccctgaatacctgtaatagtgttttgttatcttcgtccacaccataaaacagttttctaacaagatcaacagtgataaccttgccggaagtttccagttctctataaatttggtgtacgtgcgaacgtgtgatttctaagtagtggttcagttccaccgacatacggtctttaccttttgaattctcttttgcctgattccataggtttaagggacagcttcttttgatagaaatatctaccatacagccgtttacggtgattctcatgcacacgggtgcttctccgttctttaataatttgcctttcttgatgaagaacaatacagaaaatgattttcgagccatttttacatcgtttttaaagttacaaaactatgtattctcttccaaagtaagtctatgcaaaatactatgaatcagtgagaaaggtgcaaattcgtgggacttttttgaactaaattttagtcccacgatttatccaccgataatatgcttgaaacggctattttttgctacctgctagaaaaaagaaatccctgataatatctgattatcagggatttgcttgatttttattttgttttcagtgatccgcctggggctcgaacccaggaccccaacattaaaagtgttgtgctctaccagctgagctagcgaatcatcctatgcgttacttctgtaatgcgggtgcaaaggtagggatatttttttaatacgcaatagatatggctatttttttgcgattaaatctgaatttatttcctcttgtttaggttgatgagcaaggcttctggaatctaactcattatattcatgcaagataaatcgtttataataagataagcataaggttgttaatgggagggctattattaagccgataaagcctaagatcgttccccagatggataatgagagtaaaatgatggcgggattcaatcccatagccttacccattatgcggggggtaagatataaatcctgtatacattgtacgatacccaagactaaaatagccaaaccaaagatcaaccagaagttctcgcctgtctcggccgaacgcaataagctcaatagaatcatcgggatgataccgatcgcctgcatatagggaattaagttcagcacgccgataaacaagcccagcgtgaccgccaacgggaaattaatgatcttaaaaccgatcgcgaggagaatcccgacggagagagcgatcagcgattgtcctcggaaataacggttcatgctgtattccacatcctcagccaaaccttgcaggaacggacggtaacgctccggtatcaaatcgatccaaccattcgcgatcttctcatagtccaaaaggatgaagataaaataaagcaagatcacgaacacgatcgtgatactgaaaaggatcgagaaggtgttcgataagatagaccataactggggtgctatctgcttcaccgctttcaacaaattctccttactcaataactccataatctgagcgaagttcacattactttccagatattccatccatgaatgcggaatcaaagggacatgaccttcaccgggatcatgtgtgcggatcagttctagcgttttatccgcctcagccgcgatggaaggaacgaccatgactatcagcaacgttatcaacagccctaaagtcaccaataccgccataatcgataagatacggctcttaaagcataatttatattggaagaactttacgaacggttgcatcatgtaagccagcaaccaagcgatcaggaaaggtaacaatgcgttccgtaataaggctatcaaatagataatccctgagatgaccagtataccgaacactatgcgtattacacggtcaaacgtaaaaggcttgtcaaacagtggattcatattattttcatatctttgcttgcgacaaagatagaataaagtagaatatataaacatcatgatacgtaaaatatcctttttcttcctcatttcttgcttatacctttcagtaggggcacaggttccacaacctatcaagcaattcctgcgtaagccttatatggaaggagcctcattttccttgatcgtgaaagacgttcacaatggcgagacggtattcgcttacgataccctccggcagctgaccccagcctcggtcatgaagacggttacgaccgctaccgccttggagatactgggcgaggattatcgctttcccacgacattggcatacgatggctccatcgagaagggcttgctaaaagggaatctatacatcaagggaagcggagatcccagccttggctcagcgcatttcgccccgtatcataagcggttcctacaggaatggatctccgccttgaaaaaggtgggtatccataaaatacaaggtgccgtaatcgctgatgaaagtatattcgacacggaaggcacttcctttaaatgggttggcgaagatatgggcagctattatggcgccggaagctatggactttgcgtattcgacaatctctataaattaggactgcaaaccggggctcccggaagccgcccgaagttgaaaggaaccgaaccggaattatccggcatccatttccataattacttaacggctcagcaagtatcttcggatagttcttttatcgtaggggcgccattcgccacggaccgttatttatacggaattgtccccgctaaccgggaatggtatccgctcaaaggggatatcccggacccggctcttttcctagcggattatctcactaggcaattggaacatgaagggatcacggtcggcgaatcaccgtcttgtttccgtatcttgcgggaggccggtaggtggcaacccgggaaacggaccgagattgttaccacttactcccctacgcttcgggaaatcgtggaagtgaccaaccatgtcagccataatttattcgccgatgccttgatcaagacaatcggcctacgctatacgccccgtaagggagaggtcatatcttcttttaaccggggcatccaggtgcttcgggactattggcaagggaaaggactcgacctctcgtgcgtctggatgtacgacggtagtggccttgcggttaccaacaagttatcaacagcttttgtggctgatttattgatttatatgagaacccgttcacaacaacacacagccttctacgaatcattgcccgtagcgggggtagaaggctcggtgaggaacttcttaaaaggctcatccctccaaggaaaagctcatcttaaaagcggaagcatgagccgggtaaaaggatatgcgggatatataaacaaaggcgataagcaatacgccatcgccctattcgtaaacaactattcctgcgacggacgtcctatgaccgtagcgatagagaaattattgctccagttgttcaactaaccagcggttatttcggcaggatcgatctacgctctatcatctctaggaaatgctgtttataattgtcggagatcgggatatactcctttccaaagacaatccgattccgctcgatcaccttgatcttctccggctggacgataaaagagcgatgaacacgcacaaagcgatccgaaggtaacatatcctccaaactcttcatgctcatcaacgaaaggaccggacggggctcatcctccacgaatatcttcacgtaatcctttaatccttcaatatataatatcttgcgcagctctatttgcaacagcttatactcactcttgacgaaaatactctccatcccgcccctctccgcgattgacgcggattcctccttctcttccgaagacaccggcttacggagcaactcataccatcgcaacgccttattcgccgaggcaaggaagtccggatagctgatcggcttcaacaaataatccagcgcgtttacccggtaactatccacggcatattgatcgaaagccgtcgtaaagatgacacgggtatcggcgttcaagatacgggagaactccaatccgctcaactccggcatctggatatccagaaaaagcagatccaccggccgatcccgtaagtcggaaagagcgtccaaggcactattataagtcccctgcaaatccagaaacggagttttcaagacgtagctttccagcaagctaaccgctaaaggttcatcgtcaataatagcgcaagtcaatctcatatctcagtctcgtttatagtaattgatagataagaagaatagttatccccctcccgaccgcattggaacgagaaatgccccggatagagcagccccaagcgtttctccagattcaccagcccgataccggaaccacttttatcttgatccgggcttttcgggaaatagctattcacgatagtacaaaccacctccgccccctcctgatggatatccaaatggatgaaagacggcttattattgctcaccccatgcttaaacgcgttctcaaccaaggagataaacaacaggggagcgatcaaggttcccggagaggaagcgacgatattcgttttcagctccacatgtttgggcaggcgtatacgcatcaactccacataattacgaaggaagtcgaaatccttctccaaagggacaaaaggctggctactctcatacaagacatagcgaagcaagcggctcaaatcgtgcaccgcctcctgcgccttctccgggctgaacgctatcaagctatagatattattcaacgtattaaacaggaaatgcgggttaagctggcttttcaagttctgcaattccgcctcggcacgctccttctccagttcccgctggatagccgccacccggtaccatccgtccgtcatcttgatcgccacgctaaggccggctaccaaggagtagataacggcgttgacgagaaagaaccccaccgtctcgttcaacgggcggggcggacgagccggatgatgcatctccggcggatagaaatagcgcatgcagagatgcacgaacagcatcatacccccgataagcaataggttgatcagcaggaaacgccctgtccggcggttaaacaaataccgcctcaccagccacccgtaattcaagtagaagacgagcatgaaggaaagcggcacgatgatgctccggaaatagccctcgaacgtgacttgcgactccctccccgtgaagaagaagggggaacagaataggataccccatcccgcaatgtgtatcaactttcccaaacctttgatagggggggattgtggtgtgtcattcatcttattatcctctttagtgctacgcaaatatagtcattcctaccgttatatgagccatgtagccttatctagtgagcattcgtctactcatagcgtatggcctcgatcgggtcgagctgcgccgccttcttggccgggtaccatccgaagaacacgcccgtcaccgtacataccacgaaagagagcagtacgctccatggctggatatagatcgggaaatgcgccacgacattcacgatcaaggcggctcccacgccgaaaagcacgccgatcaatcccccggtcacgctgataaggatagactcgatcaagaactgagccaagatatccatgcctttcgcaccgatactcatacggaggccgatctcccgcgtacgctccgtcacgctcacgtacatgatattcatgataccgataccaccaacgagaagagagataccagccaccgcggccagcaacgtcgtcattatatccgtcgtacttgtcaacatcgtactcaactcctgcatactccggatcgtgaaatcatcatcatcggtttcccgcagcctatggttacgcctcagtatctccgatatctcgtctatggcttgatcggtgtactcctccttgagcgccgagcaggttatgccttgcaaatgggtaatggccaagatcttcttttgaatagttgtgtatggagctaagatcaggtcgtcttggtccattcccatgctgttatatcctttgcttttcagtacgcccacgacccggaacggtagcttctggaaacggatcacccgtccgacgggattctctccgccggggaaaaggttatccaccaccgtcttcccgatcacgcataccttggcggcggtctgtacgtcttgatcgctgaacatatcgccatcctccacctcgtatcggcgtatctccatataatccgggctgataccgtagacggtggtcggggcattgttggcgccatagatggcctgcccgctactgttcacggagggagaggtggcggagacgtagcgagtctcgttcacgatatcctcgtagtcctgtagcttcagcgtctccatggcagaggcgtcttggcggacaccaccacgcatgtcggctcccggctggatcatgatcatgttcgagcccatctcgctgatctgcgcctgtatactccgcttcgaaccttgaccgatggccagcatcgtgatcacggaagccacgccgatgatgatacccagcatcgtgaggaatccccgcagcttgttgttggccaaggcccggagggctatctttagtaaattcgtcgtattcattgttacttctgtttatcgcttaatcatcattcttgggcaggcgggccaaagcctcggcggcgctcaagatattcgtattcaccgtatcggcggttacatgaccgtcgcgcaacgtgatattccggctgctgtattgggcgatctccgggttgtgggtgacaaaaataatcgtacgtccctcggcgtgcagacgctggaagagcaccaagatctcaaaagaggtacgggtatccaagttgccggtagcctcgtccgccaggatcaccgccggatcgttcaccaaggcacgggcgatcgccacacgctgcatctggccaccggacatctggttacttttatgcatcagtcggtctcccaagcccacggcgatcaaggcgttgaccgccttctccctacgttgggccgctttataagtaggattgtacatgagaggaagctctacgttctctaccgctgtcgtcttcggcaacagattgtaattttgaaaaacgaatccgatcttgcgattccggagggtcgctcgctgccgcttgttcatggtgcgcacggatactccgtctaagtaatactccccgctcgtaggagtatcaaggcaacccagcgtgttcaacaacgtactctttccggagccggaggttcccatgatcgtaacgaactccccctcgcgaatcgtgaacgacacgcctcgcagggcatggacggtctcgtcgccaacgtggaagtctcgttttatattgtctaatctgataatttctttcatgacgcaagctatctcttatttttgttgcttcccggagggcccggcatgaaagggctacgctccgctcctgcacctacttccggcatgttagcggcgctcgctaaatctacggctacctcatcgccctcgctcaagccctcggttacttcggtcacgctgttgttgctggttccgaccgtaatctgcctcgggctcaaggtatttccttggcgggaccaaaccaagcgttttccgggttgtacctccgcattcggatccgtcacggtcatacccaacgattccatgatggcgggctcggggataaaacgaagcgccttgttcggcaaggtcaagatattcgcacgttccaacgtataaattgtgacatttgccgtcaagcgaggtttcagtttcaagtccggattatccgccgtaattactacctcatacgtaacaaccgtggaagaagaagtactggaagaagcactggaagtgctttcgctgtcccctaaacgaatctgacgaaccacgccctcgaattgatcgttcggataggcatccaccgtaaaactaacccgttggccttcctccacattacctatatccgcctcatccacatccgctattacctgcatcttcgtcaagtcggcggcaatggtaaacagcgtcggggtctcgaagccggcggcaacggtctgcccttcctcaacggcccggttgataaccactccgtctatagggctcgtgatcgtggcatattccagattacggtttacttttaccatggaggcctgactctggtcgtaagcggccttcgccttctcataattataggtagccgtctcataatccgtatcgctaatcaattgtttctcgtgaagcaccttgctacgtgcgtagttcttctgttgatactcgaactccgtcttgctgctcgccaattgcgcctcggcggaacgaagctcggcttggaggttgatcttatccatctcggcgatcagttggccggctttcaccacgtcgttataatcagcgtacaatttatcgatgataccggagacctgcgtacctacctcaacctcggtaacgggctctaccgtaccggtggccgtaaccgtattcgtgatcgtgctgcgccctactttagcggtctccagcttgattccgcctttcgaggatttgcccgtgaaaaggaacacgccccccgcaatgaggataacggcaacaccgcccatgattagtttcttcttgtccatattctgattcgttttatttctgttttacgttgtattcttgttcaaaaggcccccgcgacctccgtcgcagggtaaccttgaaaaaagagagtggagtaaatatatatatccattagtgggttaataattctccgcaaccggcttcttctgataaacattcagcaattgaacgctcatcaaggccatgtatttcgcttgtagctgctcttgctgggcggtcagataattgttcttctccgtcaatagctcaagcgtatttttcataccgaggctgaattgctcatcgatcaagttatagctttctttcacgtaactcaagcgttcggtagccgaggtatattgggtctgcgacgaggtagcgtccagatagatcccctccacggtttgcagcaattgcttttgggcattcagcaactccaactggctggtggtaatcgcgtatttcgccttgttataggccgtcttatactggcggttactgaagatagggatgctgatcgtcaatccgacactctcgttgaagctattccagatctggctaccgaaagcgtaatccgttccggaaagatggccggtacccagcccggcgttcatggagagcgaaggaaggaaagcacctttcgcctttttcttctccagctcggcgatgtccacggccagctcactgctctttatttgcggcatcacggccagagaggtattgtaaatcgtttgcttgctcggaagcggggttaagatatctttctccgtaagctccggcatcaccaattcgatctcttcggttatatccagttctagtaattgcttcaattgcaacttataattgtctagattcgtctgggctacgaccaattgatatttatcggtgcttaactggctttccaactgagccaaatccactttcgagatcgaaccggcacgtagcaactccaccgcacgatcccgttgcgccgtagatacctcgaccgtattttggttgatacgaacggactccatcgcatatagtacctgcatataggtctgtatcaaggagatttggatatcatcctcgttttgctcgatacccagctcatcgacggtattttgtatttcctgttgcttgatcgcctgtacacgttgccctccatcaaaaagcgtccatttagcgttcagcgcataattaccgctatagctattattcgtagcggcgtcgctcgaaggataattcacgaatccttgggtaaccgaagccgaaagggaagggaaaagctgtgctttcgcctgcttcgtatcctctataccggaaagatgcgacaccttgcttttctttacttggatattatgctccaaagcgtaatccaagcaagcgcgcaaagtccatcgggtaggttgctcttgtgccttactccccacacagaggaagaacagacatgcgaataataaagcgtattgtttcatattgccttcgttttctatctttttacgaaagcaaaactatattaccttaaaaacatgggcaaccagactagaaaaaggggctgttttcaccgattaaacgggcaattgcatcgacaggaaagcgtgcggatatatatttataaggccatcgatttgacaatttgacaaaatgataaccgaagtcccggagaatcgattattccgggcaaaggtacggctcactcccaaatacgaaagaaaaaaacggcaatcatctcgctaatagacgaatacccaaaaacagtcttttattccagtgaaatgaattcatcctaattcatctatttagacaagaaaaagggtgaaacagtgttacgatagggttgtaacaggctacgaatgcctattcacaggtactcacaacccaatgcacagccgctcacaacgcctaacgcaagtatacgcatcaaggaatgcgtcctctcgcaagctgtctcgtcacctattatgtcccaaatcggcctctttttaacgaaaaagcacgcttatcaccacttctttcccacaatctcgctacctccgcacaaaaggtgtgtcagcggatttgcgttatatcgagcaagaagtaagaataaacgccattccacctatcttttatcggctcaaaagtagtcattcttcttaaagaatcagctcaaattgagccgatttgatcctcaataatacaaaataaccccggcgatacctgccaaaataatcatcaagataggatgtatcttgaatttccaagtcaagataaaggcggcgccaaagatcaagaagctcttgtagtcgatgaagttctctttattcattaatagcaaggcggcggcggcgatcaaaccgaccgtagccgggcgcaatccaaggaaagccgcctctacatatttattattccggaacttagcgaagaaataagagatcaagagaaccaatatgaaagagggcagacataccgcgaatgtcgtcaggcaagaccctaggatactcatcgtctctgaataccccgcattatgcaccgccgtataccctatataggtggcgctattgataccgatcggcccgggtgtcatttgagagatagcgacaatatcggtaaactcctgcaaggaaatccaaccatagcggtccaccacgtcggcttgtatcaaggataacatcgcatacccgccaccaaagcccaatataccgatcttcagatatacatataataattgtaaccaaatcatatcagcccttcttatttaaaccatacaccaaacctccggctatagccgccaagataatccaagcgggagacaccccacccatccagatcagcaatgccgccccgacaggtatgatcatttgcacgtaactcaacttgatagaacgtgcggttgtcagacaaggcacggcgatcaaggcgaccaccgccggacgcaatcccataaacgccttctccacccatacattatcctttacctgcgtaaagaataacgcgatcaagagcatgattacaaaagaagggagaatcgtgcccaaggcacaaacaaaaccgccccatgtcttcttcagtttataacccacgaagatcgctatattcacggcgaaaatacccggcaacgattgggccacggagaaaacatcgataaagtcctctttcgtcatccacccccggtccaccacatcccgctggataagcggcaacatggcgtatccacctccgatggtaaacataccgattttcacgaatgtcagaaaaagcgtccaatacatacccttatcagtttacgttggctaacgtcctaaaagcctattgtaagtttctttattattaataatctgaagcgctttctggtaactcggattatcatcattgataatctggaagtactgcgccatatcatagagatcccgtgcgataagcgccttgatctgaagcataatcaacggcttcgaacgattatattgctcttcctcaaactcaatcttctcatcgccggccatcttaagaagctcctccatgatatcctctccaaccacgaaatattgcttatattgctggaacttcggatatttagccatcatctggttccgattacgatccagataattcatggacacccgattgactaaaccggaagctaccagtttccggtgataatccgtatagcgagtcgtatctaccgggatgaacacgtccggcataatacctccacctccatatacggtacgctcggtaaccaaggtgttatacttcattgaatccgggaaatgaatgctatcggcactcatcaactccccccggttataacggtcgatcagatcatggtggtactcctcgatcttcccgttctcgtaaggcttttgtatacaacgtccggtgggtgtatagtaacgggaaaccgtcaaacgaatcatggaaccatccggcaggggaatcggtttctgtaccaaacctttaccaaaggtacggcgacctacgatcactccacggtcccaatcttgaatagcgccggagacgatctcgctggccgaagccgaggactcgtccaccagcacgaccaaacgtccctcttggaattgtccgcgagcggtagagttcgcctcctcacgaggttgcttactccctttcgtataaacgatcaaccggtttttatccaagaactcatccgccagctctatggcgatattcaaatatcccccgccatttccctgcaaatccagaatcaagttcttcataccctgtttccggagcttctccaacgcctccctgaattcatcggcggaagaagcggcgaaacggttcaacttaatataaccggtattcttatccgccatataagcggcatccagactatacacgggaatcttaccgcgaacgatcttgaaatccatcaattccggcgacttgcctcgctttaccttcacacgcacctcggtacctttcggtccgcgtagtttcttcatgatatcggtagtcttcatcttcacgccggcgatcaaggtatcgtctacttggataatacggtcgcccgccatcaaccccaccttctcagagggacctccggggattacctgaatcacgtaaagcgtatccgtcaacatattgaactgtatgccgataccatcgaaattgccttgtaaaggctcggtcatctctttcgtctcctccgggtccatataattggaatgagggtctagcttatccaacatgccgactatagcgtcttccaccaacttcgtctcgctagtagagtcgacatatagattagagatggcgaataaagccaattggagcttccgggcatccatattcgctttttgcgctgtcgctccggtaaacacacctaggacgatcagcagggataagacgattcttttcatcagatatattcgtttcataattttcaatacaatctcgtctctttagggacgaattgagaaatgtctttgccgtagcgtaacaactcacggacaatgcttgagctaatatgcgtatgttccggttccgtaaacaagataaaagtctcgatacccgtcaacttacgattcacgtccgcgatcgtcttctcatattcgaaatcattgaccgtacggattcctcttaagataaagccggctccgacctctttagcgaaatccaccgtcaattgattatatgacatgactttcacccttggattatccttgtatagattccagatcgcttccatccgcttctccaaggagaaataggtaagcttcttatcgttgataccgatcgagatcacgatctcgtccaccagttccaacccacgccttaccaaggattgatgcccgatcgtaaaaggatcgaaggtaccgggaaaaagcgcgatacgtttattttcaattgatgacatcttcttcaaccactaagttatcgataataaagttctgtcgctccatggtattcttccccatatagaactcaagcatatctttcacgaggtcctctttcttcattgtcaccggatcaaggcgtatatccttgccgataaaatgcttgaactcatcgggagagatctctcccagacctttgaatcgggtgatctccggattcttcccggcagcggctatggcagccaagcgttcctcctctgaataacaataccacgtcttctgccggttacgtacccggaataacggggtttgcaagatataaacatgattacgcttaatcaaatcggggaagaattgcaagaagaaggtaatcaacaataaacggatatgcatcccgtccacgtcggcatctgtcgcgataatcaccttattataccgcaaaccttccaagccatcctcaatattcaaggccgcttgaagcaagttaaactcctcgttctcgtaaacgatcttctttgtcaagccataactattcaagggcttacccctcaaactaaatacagcttggtaattcgggttacggctcttcgtgatagaaccgctagctgagtcgccctccgtgataaagatactgctttcctctagcaaatcccctttcgagtcggtcaggtgaatccggcaatcccttagtttcttattatgtaaattcgctttcttcgcacgctcgcgggccagcttcgtaacaccggcgatcgccttgcgctctttctcggactccaagatcttcttcagtaaaagctccgaagtctccatattcttatgcaaatagttatccaggtcattcttgatgaaatcaccgataaacttcgctaccgtagggccgtccggtcctatatctttcgagccgagcttggtctttgtctgactctcgaatacaggctcctccacttttatgctgatagcggccacgatacccgcacgaatatccgaatactcgaaattcttattgtaatattccttgatgacacggcctacagactccttgaaagcggaaaggtgcgtaccgccttgggtggtatgctggccgttcacgaacgaataatattcctctccatattgattgctatgcgtgataaccacctctatatcctcccctttcaggtggatgatcgggtaaagaggctcggtggtcatattctcgttcaacaaatccaccagaccgttgcgggaatagaaacgcttgccgttgtaaataatggaaagtcccgagttcaagaagacatagttctttaatagcccctcgataaactcgtccttataatgataatccttaaagatctcccggtccgggacaaagaatacctgcgtaccgttcgcctccccggtcggttggatatccgattcctccgtgacgatcgccttactatattccacccgcttacactctccgtcacggtagctggttatcaagaaataactactcaaggcattcaccgccttgatacccacaccattcaaacccacagatttcttaaacgccttgctatcgtatttagcaccggtattcatcttgctagacacatccacgactttacccaaagggacaccacggccataatcccgtacggctaccgtaccttcctcgatagtcacctcgatacttttgccataccccatcatgtactcgtcgatagagttatccagcacctccttcaacaacacatagataccatcatcggcatagctaccgtcccctagttttccgatatacataccgggacgccggcggatatgctccatccagtccagtgtcttgatgtcatcatcgttatattccgtaggttgttgtatcgttgaattcagctcatccatatctcttataactttttaatatacgctcttcttgatttatgatgctctcgcttaaaataatcccattgcgcttgtacggcactattcgtctccagctccgggttactctcggcgtaaacggcaccgatacgcttatagaccggaatcaagtcattaaataataaagcgttcacgcctttactttgatattccggcaagactcctgtcaaatacaggtcgattactttcggcttactcttcaacgctttcagcaaatgaatccacccgaagggtaacagatgcccacgagccttttgcaaggctctcgaaaggttgggcagggagataccaaagccaaccaccgcattatcctcttcccttacgatcagcgttaccaaatcataacgcagcatagggatatacatattgatataataatcgatctgcttctcggtcaatcgtgcgaaaccatacaagggagcgaaagccgcgttcaatgtatggaataccggacgggcgtaaggcataatctccttagcgttcttgaacttcagcaccttcaatccgtatttcttcttcacgatctcaccgatacgcaaatgcttctccggaacgccatccggtatatagatcttaaattcatgccaatcttgatcctttccgtatccgatacgctccacttgcttggggtaatagggataattataaatcgtagccatcgtaccgatctgatcgaaaccctcgatcaacataccctcgtgatccatatcggtaaagcccatcggaccgtggatctcctccatgccttgttcgcgggcccatttctcaacagcgccaaaaagggcatcaaccacctcgtcatcatcaataaaatcaacgaaaccaaagcgggcacgtttctgtccccaagcctcgttactcgggtgattcaccataccggcgatacggcctaccaccttcccgtccttataggcaaggaagtaaatagcgtcgcacacctcgaacgccggatttttcttcttatccagcgtcatcatctcttcctctattaaacccggtacgtgatagggattacccttgtataattcgatattgaacttgacaaacttcttaagctccttcttactggtaacttctcttatctctacgctcatcggtaattttatttaagcggcaaagttacataaataatcttttatcatggcattataaaacaaatttatacctttgtaaactcagattcatagcataccatgaaaaaaatagttattaaattaatattggcatttatcatgtttgaaggaacctcttgtataaacgatcctattataatcagccccgatctggcgtttcgggcggaagctactacaggggagggatcgatttggcatcccgatcgcaatacacttttctgggtagatattgaaggaaagacgttatatgagtatataccggacttgcaaaactgccgttcatggcagttcgaccgcatggtctctaccgtcgtaccggaaacggacagtacggtagtcgtcgctttacaaaacgagatcatacgtgtaaacctaacggatgggaacacgacatctatcgccccaatcccggacaataacgggaagattcgttgcaacgatgggaaatgcgacccgtccggacgcttatggatcggcaccatgggatttggcgcgcctaaaggggctgccagcctttattgtgtatgggcagacggaaccgtcgaaacaaagttgacaaaagtcacgatctccaatgggatcgtatggtccgccaacaagaaatacatgtattacaacgacacacctacccgtaagatcatacgtttccggtatgacgatagctccggtgacatattgtacgatggcgtagccgtaaatatacccgagggcaccggctccccggatggaatgacgatagattgcaacgacaacctttgggtggctcaatggggaggtggcggtgtttattgttacaatccctataccggcgatctgttgacaaaaattgtcgtgccggccccccacgtagcgtcatgcgcttttggaggggataagctcgacacgctttatataacgaccgcccgtgccggattaagcaaggaacagcttgaagaatatccactaagcggtagcgtattctgttgcaagcccggagcgaaaggggtgccggcgaattgtttccattaagaatccgcaagcttaataaatctaattaacacaattgtcaaccaaatatcaatttaaattgtttcctttgtagacatggcgtgcaaaagacgaggtgtgccccgtctccacaaaaacaaatgcaaataattatacagaatggcaaagaatagaccagtaaaaaaagataacaataaggagaaaaaaggaaaaaaggaaaagggtgttggtaaacgtatgaaaaaagaagcgatgatccaagccatcatttccgttttccaatccgctcccaaggaacctttcaactataaacaaatcagcaagatcatcggagtcgagaaccaagtgcagaaattgcaggtggtagacatcctgtatgacttgtccgccgaggatatcatcaccgagatcgaccgtggccgttaccgtctcaacggattgggaaccctagccgtaggaactttcgcacgccgcagcaatggaaagaattctttcatccctgaagacggaggtacgccggtatttatcgctgaacgtaattccgggcatgccatggatggagacaaagtaaaagtacagcttttcgccaaacgtaaaggtgccgagccggaaggtgaggtcgtggaaatccttgagagcaaggagcgtactttcgtaggtaaacttcaagtagctaaaggctttgccttcttgattacggaaaacaagacgttggctaacgatattttcatccctaaggataaactgaaagggggcaagaacggcgacaaagcgatcgtacgtatcgtggaatggccggatgaagccaagaatccactgggtgaggtcatcgatatattaggtatcgccggacagaataccgccgagatgcacgcgatccttgccgaattcggattgccttacaaatatccttcctcggtagagaaagcggcggataagatcccggaagcgatctctccggaggaaattgagaaccgggaggatttccgggggataacaaccttcacgatcgacccgaaggacgcgaaagacttcgacgacgccctttccgcacgccgtttggataacgggaactgggaggttggcgtacatatcgccgacgtaacacattatgtgaaaacggacggtgtcatcgataaagaggcacaaagccgtgcgacttccgtttatctggtagaccgtacgataccgatgcttcccgagcgactttgcaaccaaatatgctctttacgtcccgacgaggaaaaattatgcttctccgctgtcttcgaactaaatagcgatgccgtggtacaaaactcccggatctgccgcacgattatcaagagcgaccgccgctttacctatgaggaggcacaagaggtgatcgaaaccggcgagggagattataaagaggagattctagccttgaacgaccttgccaagaaattgcgggaacgccgtttcaagagtggcgctatcaacttcgaccgctatgaggtcaaattcgagatcgacgaacaagggaaaccggtccgtgtttatttcaaggtttcaaaagacgctaacaagttaatcgaggagttcatgctattggcaaaccgtaccgtagccgagttcgtgggtcgtcctcctaaaggaaagactaagaagacatttgtttatcgtatccatgagcttccggacccagataaaatggagaatttcgcctcttttatccgtcgcttcggctataagttgaaaacagacggcacgaagacggatgtctccaaaggtatcaactccttattagacaatgtacaagggaagccggaagagaacttgatcgagacagtggcgatccgtgccatgcaaaaggcccgttactccacggagaatatcggccactatggcttggctttcgaatactatacgcacttcacctctccgatccgccgttacccggacatgatggtacaccggttgctggaacgttacttagccggaggccgtagcgtgatacaaaagaagtatgaggagctgtgcgatcattgttccagcatggagcaagtcgccgccaacgcagagcgtgcatccatcaaatataagcaagtagaattcatgcaggataagctcggcatggtattcgacggcgttatctccggtgtcaccgaatggggactttacgtagaactgaacgagaataaatgcgaggggcttgtaccaatccgtgatctggatgacgattactatgagtttgatgagaagaattattgtttattgggccgtcgcaagaaacgtcaatatcgtttgggagaccctatcactatcaaagtagcgcaagcgaatctggaacgtaagcaacttgatttccaattagcggaataaggcctttttcaaagtaagtataacttcatcagacaacgaagttatacttacttaggcattttgattatacttactaggacaagtaagtataatttactttttatcaccaatacataagtcccagcgccccacaagcgatcagcccgattcccaacaacgcatagaagatacgtgcgccgccacgaccgaaccagttcacgaaagtcatcgccccgctggttttaaagtaccaatcaaaattacagatcgccgctacgattgagaacaatcccaaagcgataaacaaggataagataaagtattcggaaggatccatagacttacttaacctctacagtacgtgaaccgtccggattctccgagatcgttacatctaccacatctccgggtaacaactcatctattttctccggccattcaataaaacataaagctccgctatagaaatagtcttctgttccgatatcctccgcctcactcaatttattgatccggtaaaaatcaaaatgataaatcaattctcccgtcgtatcgctacggtactcattgataatagcgaatgtgggactgttgatcacatcctccacacccaattcctcacagatcgccttgataaaggtagtcttaccggcccccatcggaccatagaaggcaaagaccgtacgatcatccatcccggcgataaactccttagccgcctcatggatcttatccaaactttctattttcagtgtgctcatagcattcgtgtttacagtttatatggactgcaaagttcgtgatatttatgatatacgcaacttttcggcatattatcatttcggttccatcgtaataaacggcaccaacatctcctccatcgagattcctccgtgctggaatgtatttttataataggatacgtagtagttataattattcggataagcgaagaaattctctccgtaggcgaaaatatacttactgcttagattcggggagggaagccctactttttccgggtcccggatctcaaatacctcttttggattgtagttcaagttcttgcctaccttatagcgtagattggtattcgtattcttatcacctatcaccttgatcggattcgttacccgaatcgttccatgatcggtcgtaacgattacttttcctccccgctcggcgattcgtttgaacaactcaagcgtagaagagtgctggaaccatgatttagtcaaactgcgataggccgcctcgctttgcgccaactcgcggatcatcttactctccgtacgagcatgcgaaagcatatccacgaagttcagcacaatcacattcagttgattacgagtaagagaagggatcgtagccaacaatttctctccatattgggaatcgtgtactttattatatgagaaggtatatttcttacggaaccgatcgatctgggtttgaatcaatggagcctcattcaaattcttaccttcctcgctctcctcatctacccacaaatccggaaacatctgctctatttgcgaaggcatcaagcccgagaatatagagttgcgggcatattgcgtggcggttggcagtatgctataatacaagctctcgtcaaacgtaaaatactcagtaagcaattcttttaccacccgccattgatccagccggaaattatcgatcaatataaagaaaaccttctcgtcattatccaacattgggaagactttcttcttaaacaggtcggggctcatcaacgggcgatcgaccggattctgtatccagtccacataattcttcttcacgaatttggcaaaagcgttattggcctcttccttctgcatacggagcatatctgtcattgccacttggctgctttccagttccagttcccagtacaccaatttcttatagacctccatccagtcgtctgtggtcaaggaatcattgatttgcataccgatacgaccgaattcctgctgataacccaccgtggtcgtctcggagataatcacgttcttatggacattcttcttgatagagagaagcaattggttgggatttaccggtttgatcaaataatccgcgatcttatttccgatcgcctgattcatgatactttcctcctcacttttagtcaccatcacgaccggcacattcggagcgatctccttgatatgcgacagcgtctccaatcctgtcaagccgggcatattctcatcgagaaaaataatgtcaaacgattgttccttacagcagtcaatagcgtcttgcccgctcaccaccggaaccacctcatatcccttgtcctgcaagaacaagatatgtggtttcaacaaatcaatctcgtcatccgcccaaagtactctatctttcttcgctgccataagcttacctagtttatttacaaatatatggataatcctccatataacaacgaaagaaacgggatgtttcgtatttgatctcgtaattttcccaaatccagataagcgaatagccaatgaggagatctccttcatcaactcacgaacagtactctctcttactgactaaggttcaaaaatatccaatttatctacaacatctacaactatccttgtaatcatctatctttagacggtttagcctatggtggtagataaaaaacatctacaattatcaggccctatctaccatcatttactacttttctatctctaaacagaacgatctctccacacttgccgcaatcatcatacggtctcttccttatacagacaaaacattaacatataagcttatacagtttttatccatgaaaaactaaagttttataccgctaaaacctttgttttccgcttaggaaacttttgtttctatatagggaaactaaggtttcttcggcacgaaacttttgtcttctgtaggaatgaagaaaatagttccctaggaactatgttcatgactatttagtgccaaatgccttttatgttaaaactccaaaagataaggcaaatatattgatttcttttagcaaaacacaatcttttctattctaaatcaatattgtcttatattttattgacataactatatgatttcagggcataaaagtcccaccggttagtctatttacgctctgtagatacaatatgtgaattaggaagaagcgtagtttgtaaataccgaatatagttcctagggaactttgaagaacttagttttacttcagaagtcatgtaatcttatttttattactcagcttataatggcaaaagacaattttaacattatttacgaacgaaactatcaacgatcgttcatgttcgctaaatcatacgtacatgatgatatgatagcagaagatatcgtatccgattctcttgtgaagtattggagactgatctccacccaaaaaggagaagcaacagaagctcttttactttcgatcttgagaaataaagctctcgactacttacgccataaagctgtacatgatgctgcgatcgaaaatctagaagaaataaaaaagcgagaactaagcatccgcatatccactttagaggcttgcgatccagaagaaattttccgggaagagatacgcacaatccttcagcgcaccctacaatcattgcccgaacaaactcgcaggatattcgagatgagtcgtttcgaaaacaaaacagtgaaagaaatcgctatagaaaccaacctcaccgtaaaaggagtagaataccacattaccaagactttaaaagtattacgtatcaatctaaaagattatcttcccttattctattttcttttttcttgacttttctcgtttttccactagggatctatcttgcagcatcgtttattatttataaagcgaaattaatagataccatgaaggaattactacaacgatacataaaaggagaggtttcagagaaagaaagactgaaaatagcatcatggttagacgaaagccctgaaaacatgcgtgaatttctggttttacgcaaattatatgacatttcactttggcaagccaatacagataagacaaattccgtaaagaaagtacattattccatacggaagataatggccgagatcttaaaaatcgcagccatctttctaatcggcttttggggaagcaaacaactgcagatacaacaatcgaacaagaaacaaatgcaaaccattcatgtccctgccggacaacgggcagaggtcaccttagccgatggtacgcatgtatggctaaactctcgctcaaccctaaaatttcctgaacaattcagcgcaaacacccgaaacgtggaattagacggcgaaggttacttctctgtccagcacaatgaaaatagtccatttaccgtacatacccaaaatcatgatgttcaagtattaggtacagagttcaatgtaaaagcttaccataacacatccttgttcgaaaccgcccttttaaagggtagtgtaaaaatcagttcccctaatttaagaaatggattacaactcaagcctaatgaaatcgttagtatagagaataggatgctcaagaaatctacaattaataatagcgactattttaaatggaaagaaggcctgttctgttttgagaatgaatcaatccaagatctaataaagaaactagaactttattatgatactacgattgagatccaacgtccctcattgttgaaacatcactattccggcaaatttcgtattcaagatggaatagagcatgtattaaaagtacttcagttaaaacataaattcacatacatcaaagatgacgataagaatctaataatcataaagtaagaacagaatgttaaccttataaatcatgtatgcctatgagataaaaaatatcaaaaaagaaacggtatataaaaaccgggaaatgcggcaacactccccggaaagaatcaataccacatgcacttaaatcatcagtatcaaattcaagagttacaaatgtatgaaaaatcaaacaaaaagagttatgaagttaacttttataacactatttctatcaaccacaggaatgtttgcatctgttaattcgcaaaatacacgggtcaatatccatgtgaacaatgcaaacactcaaattgtcttaaacgaaatcgaaaaacaaacagactatctctttgtgtacgacaccaaagaaatagatctaaatcgtaaggtttccgtagaggcgcaaaataaaaccgtagcagatgtgttatcatctgtctttacccaaacagacatctcatatgcgatggagggtaataacatcatgttaatgcgaaaaaacacttctgttacacaacagagtaaccggagaattaccggtgttgtgaaagacgcaattggtgaacctatcattggagcaaatatcgtggtgaagggaaccacaaacggtataatcaccgacattaacggaaatttcagccttatggtctccgagaacgccatcttgcaaatttcctatatcggatatcagacacaagaaatccctaccaaagggcagacgaacatccaaattaccatgaaggatgacgcacaagcattggatgatgtcgttgttatcggttatggtacgcaacgcaagaaagacgtagccggatctatctcttccatatctacgaaggatttatctattcaatcatccgggaatatacagaaccttcttcaaggtaggttatccggtgtgtccgtaacaacttccggcgtagctggcgatgctcctgctatccgtattcgaggtgtcggaacactgaataataacagcccgttgtatgtcattgatggttttcctacaaaaagcgagatcgcatcccaaataaatccttcaagtatagagtctgtacaagtattgaaggatgcttcctccgcctctatctatggttcccaagcagctaacggggttatcttaatcacgacaaagcaaggtaaagaaggaaaacctaccgttgacgtaaaagtaaacgtaggcgtgcaacttcccaccaacttgccggaaatgctaaactcccaacaatatggagaagtcttgtggaacgcaatgagaaacgccgggttaacaccacagcatgaccaatatggcaacggagctacacctgtcattcctgattatattctaccggcaggagccatggaaggccaggtagatctcagcacttataatactgcggaaaatcaatttatgcgcgctaataagatcggaactaattgggctgatgaagtttatcgccccgcaccgactacaaacattgatatcagcgcacaaggaggtggcaatgggtctaaatatttcttgagcgcaaactattataaacaagaagctcttgtaaaatgggcgggctatgatcgcttctctttacgagccaattctcaatttaagattttgagcttcgccacattaggatcaaacctaagcgcaacttactctaaatacaaaggaagcaaatcagaccatgaggccgtacgtatggctccgcttattccggtttacgacgtagaaggtaattgggccggaacaaaagctaatggtttaggtgattccaagaatccggtagcccaactttataatcaaagagagaattacaatgacaacctcaacttgttaggtaatttgtatttggatatcaatttcttgaaatacttccaattcaagacaaatgtcggcgtaaacgttgaggatagcggctccaaagagttcaatccaaaaacttattggaacaaaggagacgcaaatacgctagtgaattctttaaaggaagcaagaggccgtaaatcagaattggtttggaacaatactttgaccttcacgaaaaaatttcgtgaaacacataatctgaatgttttgctaggtacagaagccattagttctaaaatagagaatctctctgcttatagaagtaattttattatcgaggatcccgattatagataccttgacgctggcgaatccaacaaggacaatacaggcaacgcaaatgaatacgctttgttctctctgttcgcacgtgtcaattatcaatataaagacaaatattatttaggggctattattcgtcgagatgggtcctcacgttttggtgcgaatcatagatatggctacttcccaggggtaaacgccgcatggagacttacggaagaaaacttcatgaaagggcaagatattcttagtgatttgaaaatcagagccagttacggtttgacaggaaatcaggatatcgataactacgcatttgcgtccatgtattatacgaatatctcaactagcagctatcctatagcgggagatccaaactctgtcactcaaggtatcagtaaggagagcattggtaatccggatcttaaatgggagacgactacacaaacaaacattggtatcgacgcaggtctttttaataataaactgaatttgtcattcgatttctaccataaatatactaccgacatcttgcaaagaattacttatccttctaccggaggagtggcaagtgccccatttatgaatatcggtgaaatgcaaaataatggatatgaattgaatatcaatttccagaatacgacagactatggtttccggtacgaattagggctcattttgtccggatatcgtaatgaggtaaagaaattagcttcaaatcaattcatatcgaacacatatacaagaacagaagtaggtcatccgatttcctctttctatggctatgtgatcgatggtattttccaaacacaaggcgaggtcgactcgcatgtagaacagtcagacaaagcaatcggccgttggaaatatagagatgtgaataatgacggaaaaatagacagccaagatagggcctatatcggtaatcctcaccctgatttcgagtactctttgagttcacgcttctattacaagaacttcgatttgtctctttatatccaaggcagtcaaggaaatgatatttgtttcgcatcgaaaggcggtagggatggccttgatttctggggagattatttcaataaaagtacccgtatattgaatacttggactcctgaaaacagaaatgcggaactgccggagatcaatatcttgaatccaaatgatgaggcaggtaaggtttcttcatacttaattgaagatggttcttatattcgtttgaaacaattagaattaggatatacccttccaaaacaaacgctttcgaaaattggactccagcaatgtcgtgtttatttgaatgcggaaaacttattgacattgacaaagtataacaacattgatcccgaggttaagaacggcgatgacaagaatatgggtgtcgattatatgaataatatgccactagcacgcgtattctccattggtttcaatttatcattctaatacttaaaattaaacaaacatgaaaaatctatttcatatagcgaaaaaaacgttcacatgggtaaccgtcacgatggctgttagcctgtttaatggttgttctgattttttggataaacaaccattaggcaaattgaatgagtctgtattaacagatgaaagtaccgtgaataaactccttattgcctgctatagtccattaaacggatttatcaacggagtttggggaataacaagtgggccggataatgtcttctatggagatatgtgcgctggaaatatccataaaggaagtactaccggcgatcaaggcgaactgctacagatggagcgttatgtcgctactgctgaaaatggtcgtatccgggataaatggatactggtatatggagctattgagcgttgcaacgacgtacttcgtatgctgaatgataataaaattgatggcttatcagaagaaagtgaaatggaaattagagcagaagcccgtttcctaagaggatattatcattttgaagcgaaaaaaatctggaacatggtcccttatattgatgaatacgtagaagatccgcaaagaagggttcccaatgacaaagatatttggcctaatattgaagaagacttctcttttgctaccggaattttaccggataatcagagtgagcctggaagacctacgaaaaacgccgctaaagcgttcttggccaaggcttatttattccagcaaaaatatagcgaagcaaaagttttattagacgaagtcatcactagcggaaaatataagttacttgacaattattttgataacttcaatgcggagcaaaacaataacgcagaagtggtatggtctaaccaggtagcggtaaatgtagcgggagctggttacgatcgtagccaacgtggtttcgacttatcttatcccaatgctccagatcaaccaaacttaagtggagccggattccaacaacctactttcgacttagtgaatgcctatcaagtagacgaaaatggcctacccatgattgacacttacgctgaccatgaattcaaaaacgaccaagatatcgaatcaagcgaggcatgggaaccagatatggaaacccctgtagatccgagattagactgggtcgttggtcgtagaggcattccatatcatgattggggattgcacccgggaaaagcttggatcagggatcaagtcagcgcaggtccttataaccaaaagaaatggattatattagaaagccaacttgctacatacgcttatgacaatacagcaaaatttaacgcaatgaatttcaatattattcgatacgctcaagtattattgtgggcagcggaatgtgaggtggagattggtaaccctgagaaagcaaaagaatatgtcaatatgattcgtcaaagggcaaaagacggatcttacgtgagattaggagatgaagcaccttttggcaatggtccagctgccgccaattataaagtggatatctataaggattcatgggcaggactaagtaaagatgtattacgaaaacgtgtacgatttgaagaacgcttggaacttgcgttagaaggtcatttcttcttcgatttggtacgttgggatatcgctgaggattttttaaataaatatgtcgaaagagaaaaaagacatatccaatatttaaatggagccgtttttgataagaaccatcgctattacgctattcctctaactgaaatagatagaagctatgtcgatggtaaaccaacattgacacagaatccgggatattaattatagtaagtgtgagggggtatcataatatcccctccacttttatctacaaaagatttgaatatgacgcaatatctaaagtcactttatctatgcatttgtttactggggggatttatatcttgtcaaacaaatgaaagtatcactcaagatgaggagatacaaacaatcatggaaggaatctcgaatcaagcgggtcaagaaaaaaatccttatctgacagcaggagataaaacctacataataggtacgcaagatggaaacttccctgatcttggtggacatactcccggagagatgggaggagtttggaatcatttgatcaagctattagatggcttttgggtaaaaatgacagataataaaggtaattcttgttggttggaaaacgcaatacaatatacgaattatccttttggaagtaaatttgagtacgctcctttatttaataatagtatccgtgtcaatcgtttccaattttgcccacaaggaaaaaatggtgttgttattacctataccatcgaaaatgtatcggattcagagcaaacggtcctttttgattttgtcgcaaaaacagatttgttgcctgtatggtcatccgggacaatcgggttaaaagacgcaaatgatgtcgtgaactgggatgcccaagatgccatttttaaagcgaaagatttaggtaataactggaacgtgatttggggagcggatcaacatacgagtatttatcaactagatactcctacttatataaatacgcaaggaacgggtaaaagtgcctcttctacttatacgattacacttcctaagaatcaggagaaaaaactttctttcgtcatcgcaggatcaaaagacagtgaggaggatgccctaaaaagttacaaagacatcttagcgaaccattccgaaatgttggaagataaaaaaatgtattacacccaactattagagagaggacggattaacattccagataaaaagttacaagaggtttataactggtgcaaaatcaatacggaatggcttgcggcagatatggaaagtgcaggacgctttctgggagcgggcgcaattgaatatccatggttattcggttgtgataattcttattcattacaaggccttgtcgctacaggtgaccaaaaattagcaaaagagacattgagagttatcaaagagatgtcagagaaagccaataggaatggccgtattttgcatgaaatggcattcaacgcattcgtcagccacaaaggaaatactcaagagactgctcattttgtcatcgctgtatggaatgtttataaatggactggtgataacaaattccttgcagatatgtatccttatatgcaaaaaggtctgaacttccttttgaaagatatggatacaaataagaatatgttccccgaagggtatggaatcatggaagttagaggattaaatgcggaattgattgatgtctctgtttatacccagcaagcactggaagttatgtcgcagattgccttaataatgggagaagaagcatttgccagtgagtgcgcctcgcaagcaatcgatttgaaagaaaggataaacgacctattttgggataaggatttagaaatttattgtgatttttatggaacgagagagcaagccttagaaacgactaaaggtgctatcgaacaggttcgtaatacagaatacaggtgggatgttgccgaggtttccttacaggaatatgaggatagcaagaaaaagcatatcgcaatgtatgaggatatgtataaacaatttgaagcgtatccaactggtattatgaaaggatggttaactaacaagaattgggtaataagcactccaatagaaactcatattgcctcagaagacagagctattcggcaattggataaagtacgaaaagagcattgcggcgaatatggtccttatttatccgcagtcgaaagagatcgcatgatgactatcgcaacaggcgtacaagcgatggccgaatgcgcttacggacgtgtagatgaggctttatggtatatcaatcgcatcgtcgatacatttggccgtacacttccgggatcaattaatgagatgatgcctgattatggctgccctgttcaagcatggaccatctatggtatagcaacacctttgattcgttatatatatggcatacaaccagaagcctataaaaagaccttgaccctaagtcctaatttaccatcagattgggactttattgaaatgaaagatcttcctgttggaaataataagattaattataaagtaaaacaactggaagatggattggaaatcacgttagatacaactgaaaaggattggagttacctattaagaccggtaaaacaacctatcaagcgatttatcgtgaatggtaaggaacaacggatttagagagagacggggcatgccccgtctccacatatagacaccgcctcataatgatctaaaattaaaacagataaccccaactattttgagtaaatagaacttagtctgaattccgtattcaagacctctttccactctaaccttttactatcaatgcgataaatggataacaatcaatttctttcatcccatattatacttgagataaccggaaagcggggaaaatgaaagtatgattactttaactatttttctatcaaaaattcctacttttaccgctaaatctgtattgaagatgaaaggagacgattttaatatcatttatgaacggaattaccgacggtcattcctgttcaccaaatcatatgtacatgatgacatggtggctgaggatatcgtagctgaatcgcttgtaaaatattggcgactggtctctgctggagaaaacgagataacagaagccttattgctcacgattttgaaaaataaagcccttaactatttacgccataaagccatacatgatgccgctattgaaaatttagaggaaataaaaaatagagaactaagcattagaatttccacactcgaggcttgcgatccgaaagagatcttctctgatgaggtcaataggatcatccacaaaactttaaaaaacttaccagaacaaactcatcgaatattcgagatgagccgcttcgagaataaaaccgtaaaagaaatagcggatgagacaaacctcaccataaaaggtgtagaataccacataaccaaggctttaaaagctttgcgtatcaacttgaaagactatctacccttattttattttcttttttcttaatttttttcatttttccactagggatttagcgcacagcgttgtttttataatagaaaataaattaacagacattcatggagcaattactacaacggtacataagaggtaaggtttccgaagaagagagactgaaagtagtgtcatggctggacgaaagtcctgataacatgcgtgaatttctggctttacgtaaattatatgatatttcactttggcatacggatacagagcaaaaaacacttcataaaaaattcattccaacaattcgacgtatcgcaatcgaaacactaaaaatagcagcgatctttttaattggaatctttgttactaaacaattcgtagaacaaaaggtagaggatatacaaatacaaaccatccatgtacccacaggtcagcgagctgagttaactttagcggacgggacacatgtttggctcaactctcgctcgacattgaaatttcctaataaattcggcacaaataaacggaacgtagaacttaacggagaagggtatttttctgtacatcatgacaaaaaacgtccttttaccgtacaaaccgaaaaatacgcaattcatgtattgggtaccgaattcaatgttaaggcatatcacaacagtcctttatttgagacagcattattaaagggcagcgtagaaatctcttcctcaaccatgccgaagagattacgcctaaagccgaacgagatggcgatcgcaagtcaggaaggattaaatacatcctacatccccgaccacaattactttaaatggaaagagggattattctgtttcgaagacgagtcgatccaaagtttaatagaaaagctacaactttattatgatattaaaattgatgttcaacgaccatccttacttcaataccgttattccggcaaattccgtatcaaagacgggattgaccatgtattgaaagtattacagttaaaacacaaattcacttatacaaaaaatgaagagacgaatctaatcgtgatagaataaatatttagtcgttaaccttttaaatacaacagaatatagagaatgaagacatgacaaacaattaacagcacaaatttcacaaaaagggagatgctgcaacatcccccttccgtaagtcagtaccagacttgcgaaaataaattcatttagtactaacaaataagacattacaaatgtatgaaaaaaatttgtaacgggcattttatgtccccttttaacacagaagataaaacatttcgaataatgagattaacattcattgcattatttgtattcagtttcagcttactcgcatccgtacattcacaaacgatgcgcgtcaatatcaatgctaataatgaatctacgcattctattttagaacagatagaacagcaaactgattatctatttatttataacacaaaagaaatcgacttaagccgtaaagcatccgtacacgctcaagaccaaacggtaatggacgttttgtcacaaattttcagaaacacggatattggatatgcgattgagggcagtaatatcatgttgatgaagaaagatgaaaaagcagaaaaacaacaggacaacaataaggtctcaggaacgattacagacaaatcaggagaacctattatcggcgctaacgtcgttataaaaggaacaaccaacggaaccattacagatatagatggtaattatgcgttagatgttcctgtttctgccatcttgcagatttcctatatcggatatttgacacaagatgttcctgtaaatggaaaacaacaaatcaatgtccgtttagtagaagatacgcaacaattagacgaggtggtagtggttggctatggtacacagaaaaaaggggaattaacctcatctatttccagcataaaaagcgaaacattcattcaaggttcagtacaagacgcagcccagttgcttcaaggaaaggttgcgggacttggtattgtcatgcctaacggtgatccgacgtcttcatcccaaattgtattgcgtggtatcggctcactaaaaggagaccgggttccattagttattgtcgatggagttccgggtgatatgagcactgttgcaccagaagatatcgaaagcatagatgttataaaagacggctcagccgccgctatttatggaaccagaggaaataatggcgttattttcatcaccacaaaaaaagtgaaaggagaaatacctgtgactattgatattcaagcctatgtcactacccagcaaatcaaaaaaagattagatatgatggatgccaatcaataccgtcaattagtaaaacaagggaaacccggcgctattgattatggttacgacacagattggctagaccagatattaaggactcctatttcttacgtaactaatgccagtctacgcggaggtaatcgcaactctaattatatcgcaaacataaactataagtctggccaaggcattatcaaacgctcagacaatagagtattaaccacacgattggaaatcaaccattctatgtgggataacttattgaagtttaatttaaacatcatgggtaaagaacaaaaatatacagccttaggagatggcaaaagcttcaatggggagatttaccgaaatgcgttaatcaatattccaacagaacgttcgaaagacgataacggaaactggattgagcatccgacaatgaacggatatatgaatccggtagctgcgctatatgaaagtaatggcgagaataaaagtactcaattacgtacattcggaaccgttacattgactcccatggatgaatttttcgtaaaagcattagtgtcgagaacctcttataatcaaacccgcgggtatgctgaaactaaaaaacacatatcaactgtccgcaatggcaaaaacgggtttgcttctcgcggaacaacagcttctatcgataatctgttagagatcacagcccaatacaaaaataattttggtgctcataaccttactggtttagcgggttattcttatcaagacaatacctatgaaaattattggatgcaaaactgggattttccatccgatcaatatagctataataatatgggggctggagctgccttaaaaagaggagaagttgaggaaaagtctgaaaaaaacaagtctaagttaatcggtgtatttgctcgtatcaactatagtttcaatgatcgttatttagcatctgtcagtatccgtcatgaaggagctacacaattcggagctaattataaatggggaaattttcctgccgtatccgtaggttggaatatacataatgaggacttcatgagctccttacgttttatcagtagcttgaaagctcgtttaggttttggtgtaacgggttccattcctgaagatccatatatgtcattaagccgcttgaccagcgataagaatctctatactggttctggctggctcccttcattaaaaccttcaagtaacgcaaatccaaacctgcgttgggagaaaaaggaagagtggaacttaggaatagactttggtgtccttgagaaccgtatcagtggatctatagacttttataaacgtacgacaaaagatatgctatggaactatcaagtcgccacacctccttatttatataaggaaatcctcgcgaatgcaggaactatgcaaaataaaggactagagatacacctcagtgcaatcccagtacaaacaaaagaattctcatggacaactagctttaattattcaaccaacaaaaataagttggttgccttatccaacgaggaattccaattaaaatccggttatatagaagatggctggactggcgaacctatccaacaatatacccatcgaatctttgaagggggtgaggttggtaatttctacggttttaaaactattgatatagatagcgaaggacgttggattattgaagataaaaacggtaatccaaaaccgatctcagagcaacaagcagaagataaaaaaattattggaaatggcctgcccaaacacctattaagctgggataacagttttaccttcaaaaatttcgacttaggtataactatgcgaggtgcattcgactatgacatcctcaactacccccgcatgttttatgaatgtcctgtaaacttgacccggggaaatttgcttgccacagcttatgaaccgaagtacggaaagactgtactaaacgaccaacaggaacttcaatatgttagctatttcatcgaaagaggaaacttttggaaaattgataatatcaccattggttatactttaaaacttaagaatgattatttaaaaaggatacgtatatacgcaaccggtaataacctattcacatttacaggatacagtggattagaccctgaggttaatacgcaaggacttaatcccggatgtgatgaattaggccgttacccttctacacgttcctttactttaggcgcaatgtttactttttaaaataaataaactcatgaatacaattaaaaaacatataaatatcttattattaggttgctgttcattgaactttatttcctgcacagacctaaccgaagaaatcttctctgacattactgaagatagttataaatatgaagctggagacgcgactaaagtggttggtgccgcttataccaatcttcaagattggggatattgcggttccggacaagctccaatgctgagtcaagaaatatgtaccgatgccgcagtgttccccgctaatggttccggttgggatgatggaggtgtatttcgtagaatgcatcaacattcatggaactccgaacaattacaagtgaatcgtttatgggaagtttgctattccggaattatcttggcaaaccgggctatcagcattatcaaccaagatgattttccttttgccgcaaatgaaaacaaggctgccatgatcgctgaatctcgagcattacgtgctttctattactggtacatcatggataattttggagatgctcctttagtaacggaacccacctcagaattacctgtaaaaacatcccggaaggatctttatgattttatagtcaaagaactgaaagagtctttcagcgatctcccaacagagaaaaatgaatctaattatggaagattcacattatggggagctaaagccctcctcgctaacgtatatttgaacgcagaagtatatacaggtgatccccaatggaatgcttgtattcaagagtgtgatgatattattaattcaggaaaatacagtttagacattaattatagcgatccatttaaggcacacaatgaaaactcattagaaaatatattagtcattccctatgatgaaatatttgccactggatttaactatcatttagccgccttacacggagcaaaccaaaaaacgtatgatctagttggaagcccttggggagctggggcttataaaggaatacctcaattcatcgacacctatgatccagatgacgaacgtttaaatgccacttggctaggaggtccccaatacgcatctgatgggacacctcttacaggctcttatgacttaatgggacaaccgcttatcttcgtcaacaaaatgcccaacggtattttcaccggtgaggcagaaggatatcgctggttaaaatatgaggttgagctggaagccagaagtgaactaaataatgatttggtcttattcaggcttacgcaagtccatatgatgaaagcagaatgccttttacgtactgggaaagcagatcaagcagcgtctattgtaagtatggtcagaaaaagagcttttaaagaacatcctgaaaaagcaattgtctcaggagcgcaattacaagaaaaatcctgttacaaatacggtacggtagaaaactatgtattaacttcgcaaaatcaagtttatccagaaaaattcggacgtttctatgatgaactaggttgggaattcgctggagaatcttatcgccggagagatatgatacgtttcggtcatttcacaaaagctaaatggttatctcatgagccgaatggagattataaaacggtatttcccttacctcaaaaagtagtagataccaatccgaatctggaacaaaatccgaattatcaataataacatagagggtatgtctctatattgacataccctcctttaatctcaatttctaaagctatatgaagcaataccttttactcgctgcgtctgcctttcttttgcaagggtgccagacctctaaagaagatataaaggaacagcctttgaagatgatcgagcagatcgatttctctcatgtgaaaatcaatgacaacttttggtcacccagactcagcaaacatgtctcggcgaccttgcctgtctgtatcgatcaaatagagaatcaaaccggacgtatccgtaatttcgagaatgcagcgaaaggggaaggagagcattccggcattttctttgatgattccgacgtatataaagcgttagaaggtatggcttatagcctgatcaacaatccggatcccgagctggaaaagaaagcggacgaatggattgataaattcgctgccgcccaacaaccggatggctacatcaataccttctatacactcaccggattggataaacggtggaccaatatggacaagcatgagatgtactgcgccggacatatgattgaggcaggagtagcgtattatcaagctacaggaaagcgcaagttattagacgtatgtatacgcatgacagatcatatgatgagccaattcggtccgggaaaaagacattgggtaccgggacacgaggaaatagaactggcgcttgtcaagctttatcaaaccacccaagagcagaaatatctggatttcgcttattggctgctggaggaacgtggacacggtcacggcactatgggtgatgaaggtaaatggaacccggtttactatcaagatatcgttcccgtccggcaacttaccgatatctccgggcatgcggtacgatgtatgtatttgtattgcggtatggccgatgtggctgccttgaagaatgatacgggatatatagccgccatggatcgtctatgggatgatgtggtacaccgcaatatgtatatcaccgggggaatcggttcatcccgggataacgaagggtttacggaggattacgatttaccgaacctagatgcttattgcgagacttgcgcttctgtcggaatggtgctttggaaccaacgtatgaaccaacttaccggagactctaaatacatcgacgtactggaacgttctttatataacggtgcgcttgccggtatctccttgggtggagaccgtttcttctatgtcaatccgctggaatctaagggtgatcaccatagacaagaatggtatggttgcgcttgttgcccaagtcagctttcacgcttcttgccttctatcggaaattatatctacgcctcctccgatgatgcgttatgggtaaatctatatatcggaaatacggggcaaatacggataggagagacggatatcctattaacacaagaaacggactatccgtgggatggatcggtaaaactaacaatttctacttctcagcctttggagaaagagatacgcctccgcattcctgattggtgcaaaacctatgatttaagtatcaatggcaagagaataaacgtgcctaaggaaaaaggctatgcggtaatcaaggattggaaatcgcaagatgtaatcgctctagatatggatatgcccgtggaaattgtcgcggcagatccgcatgtcaaggaaaatttcgacaaacgggcgattcaacgagggccacttgtatactgcatggaagaaatagacaacccggtatatttcgatcaaatacagttgagcccaagtacaacattccaaacagccttcgcttccgatatattgaatgggataaaaacaattaaaacaaacggtagggcacaatctgctacctttattccctattacgcgtgggataaccgtaaagcaggaaaaatgagggtatggatcccctataacgaataactaaaaaagcatcaaaatgaagtatttattaacgataacattatcaagcctaatctcaattacctccttttctgccactttgctgggaaatgaaggttctatcaacattaattacccgaacaatcgttatccattagcctctaagccttatatagagttgcctattggggatgttaaacctgcaggttggctaaaaatccaaatggaacgaatgtgtacgggaatgaccggccatctggattctatctatacgaaagtaatgggaccgcgtaacggttggttaggcggagatggagacgtatgggagcgaggcccatactggatagatggcttactacctttggcttacatcatgaatgatgaggccctgatccaaaaagtaaagccttgggttgaatggacattggcctctcaaaagcctaacggatatttcgggccagatacagacagagactatgaacccggcttacaacgggataacgcacaagattggtggcccaaaatggttatgctcaaagttctgcaacaatattattccgctaccaacgatcaaagagttatctcgttcctcactaattatttcaaataccagctttctgaactacctaaaagtcctctgggaaaatggactttctgggctgaacaacgaggaggggataatctgatggtcgtatattggctttataatatcacgggcgatcctttccttctggagttaggagagttaatccataagcaaaccttcaattggaccgacgtgttcttgaaccaagatcatttagcccggcaaaacagcctgcattgtgtaaatctcgcccaaggattcaaggaacctgtcatttattaccaacagagccataatcctcaaaatctggaagcggttaaggaagctgtacggaaaatgcgccatacgattggttttcctacaggattatgggcgggagatgaacttttacgtttcggtaacccgacacaaggatcagaactctgtaccgctgtcgagatgatgttctctctcgagaaaatgttagagataaccggagatgtccagtgggctgatcatttagagaaagtcgcatacaatgtactgccaacgcagatcaaggatgacttttccgcacgacaatattatcagcaagtcaatcaaatagcgatcacttgcgaaggacgtaactttgtctcaccacacgaggacacagacattgttttcggagaattgagcggttatccttgttgtacctccaatctacatcaaggttggcctaaattcacacgacatctatggtttgccaccgccgataatggcatcgcttcacttatctacgcaccatcggaagtgactgcccaagtgggaaacgacatcacggttaaaatcgcagagaaaaccgattatccctttgaagaaaagatcgatttcaatttatcgttccctagcaagaaagacaagaaagccttttttccttttcacttacgtattcccgcttggtgcaataatcccgtgattacgataaatggcgaggctgtctctatcgcagctcactctggcgaaatcgtacgaatcaaccgagaatggaaagatggcgatcatatccagctagagctacccatgcgtatatccacaagcaattggtatgacgatgcggttgttatcgaacgaggcccattattgtattccctaaagatggatgagaaatgggaacgcaaggttgatcaacgcccggagtcttcacataaaggagaatggtattatgaggtcacctctacttcagcatggaattattccctgattcgcaaatatctgaaagaagaagaactagagaaaaatttcgtcgttagaaaggcagagaacatagccccttacccatggaacctagagaatgcccctatcacgatcaaaacaaagggacggatcttaccttcatggaaaatgttcaaaggttccgccggccccgtaaatttcttcatgcaagccaacgaaccgatgggtgatgaagagacgatcgagttaattccttatggctgtactactctacgtataaccgagttccctgtccgatagaataatgttaataatgtgccaattgttcaatgtgccaatatgccaattccgattcaatacggaaagagtatccacattggcacattgacacattggcacattattaacattattcaattttttttcattgtatagtctttcacccccaaggaatcatacgcctgcaaaagcgcctcgtcattatcggagatcattaacaacttgtcgttctcctttaattccgtatttcctttcgggatgaaatagcggccttcccgtttcaccattaccgccaaggtatgatcgggtaaagtcagctgcatcaatttatttccatgggataataccgccggggtaatatcgatctcgctcatagcgctcttgatctcctcgggaagctcgatgccaaactcatcctttcgttccggctcatccaccatatccagccatttagcggcttgggtaaccgtggttccttgaatcagcaaagaaagaatcgtgataaaaaatacgatattaaagaacataccggcatgctcgatcccggcgatcatcgggtaagtagcgaaaataataggaaccgccccgcgtaatcccacccatgagatatacagtttacctttgaaggagaaattcttataaggtatcaagcaaaggaacacgctaatcggacgggcgatcaagatcataaagactcccaccataacacctacacccgtcaccggtaataactcatgcgggttcactagcaagcctaacgtaaggaacatcacgatctgccacaaccaagcgaaaccgtcaaagaacgtccccatacttttcttgtgaacaatcttagcgttaccaaccaccaaaccagcgatataaaccgctaaatagccattacccttacataaggtcgtagcggcgaaggtgaagaaagccgtagccaataaaaggatcggatacaaagactcgttatctatatcgatcttattgataatcaacacagccagtctccccaataagaaaccggcgatagctcccaccgataattgaatgaccaaggatagcccggcctcccaaatattcatacctccgctttgtatgtaagcgatcagaagcaaggtaagcatataagccatcgggtcattactaccactctccagctccaaggtaggacgcagacgctctttcaaataaacccctttactgcgcaagatggagaaaaccgaggctgagtccgtagaggacatgaccgccgccagcaataaagattccgggaaagtcaacgtaacatatttgccaaataaaccaaataaccaatagataaacccgcccgtgataaaggtcgtagccaacaccccgagcgtagccaataccacaccttgcgaggcgataggtttgacctccgcaactttcgtgtccataccacccgagaacaagatgatactcaacgccaacatgccgataaactgggctacattcggatcgctgaactggatgcccagaccatcgctgccaaacaacattcccacaccaaggaacaacaacaaagcgggtaagccgaaacgataaccggccttacctgcgaatatactaaaaaacaggatcaccgaggctattaatagcacttgctcaggattttgaaacatacgcaaaacgggttttatgattagtgatttgatactttgtcacaaagttcgtaaacttttcgcaattataatcacacaaaaagaagaaatccggtcccaaatttacaggaagaccagatttattctttctatagaaaaacaaatctttcttacaaattgttcgagaatttttctatctcgcatagaatcattacttttggcaaacatacatatccgctttatgaacaaaaaacatctatttgcgctgttgttcacattactcgtatggacgagctgtaacaaccaacaacattttattaccgacgccgcttaccgagctgaggttgagaacgatttccaagcgaaacaggccgctctgcctaacggaaaccttttcgcagtatttaacgatcaaatgactcccgaagagagggaggcgttaaccttcatgtacgcctatatgccgattggagacatcacggactatagtggcgatttctatttgaaaaacatccgttcctctttccaagcacggaatgagatgccttggggcgatagcatcccagaggatatcttccgccatttcgtattgccggtacgaatcaacaatgagaatctggatgaaagccgcatggttttctttgatgagttgaaagaccgggtgaagggtctctcgttgtacgacgccgtactggaagtgaatcactggtgtcatgaaaaggttatctatactccttccgatgggcgcacaagttcccctttggcatccgtgaagaccgcctacggtcgttgcggcgaggagtctaccttcacggtagccgctttacgttccgtgggtatccccgcgcgtcaggtatatacgcctcgctgggcgcatacggatgataaccacgcatgggtagaagcttgggtgaatggtaaatggtatttcttcggcgcttgcgaacccgaaccggtattgaatctgggttggttcaacggccctgcttaccggggtatgttgatgcatacgaaagtattcggtaaatacaatggcccggaggatgtcatggaacgtaccgatgggtataccgagatcaacgtgatcgataattacgcaccttcggctaaagctgttatcacggttacggatgccaatggcaagccggtaaaggacgctttggtagaattcaagatttataactatgccgagtttaacagtgtagcccgcaagaagacggacgcggatggcaaatgctcattatccgccggaaaaggggatatgctggtatgggccagcaaagacggcaagttcggctacagcaaggtctctttcggcaaggacggagaggttacgatcgccttgaataagaaaccgggagatgtggagacgatcgccctagatatcgtaccaccggtagacggctctatccccgcagaagttacaccggagcaaaaggaggcgaacgccaaacgtttattggaagaagacgctatccgtaataaatatgtagctactttctatacggaagagaaagcagaggctttagcgaaagaattgggtatcgacccgatgaagacagaggatttcatgatcggtagccgtggtaactggatggagatcgagaagttcttacgggagactcccgccgagaagcgtgtgcaagcgatggctttattggatgtcgtatccgctaaggatctacgtgatacacctgcgtctgtctttgcggaccatttaaacaatacgccggccgttcaaagcgaatggttcaatgaatatatcatgaatcctcgtgtggccaatgagttcctgactccatataagagtttcttcgctgcaaacattgagccttcccttgcgaaacaagccgtagagaatccacaggcattggtggattgggtgaagaataacgtctccattaacgatgcgctaaacgcacaacgtattccgatcatgccgatgggtgtatggaaatcccgtatcgctgataagggctcccgtaatatcttcttcgtggccgtggctcgtagcttaggtattccggcacgtatcgagccggtagcccgcaagatccagtacttcaaggacaacgcttgggtagacgtcgatttcgaggctgccgtacagacgaccgctaaacaaggcaaggtaatcgcttcttaccaaccaatcaaggcgctgcaagacccgaaatattacagtcacttcacgatcgccaaggttttgccgaacggtactttacagaccttgaatttcgagagaggcggtaatgtggatatgggcttgggagatacttggagcggattactgaagaaaccgttatccatggatgaaggtaattatatgttagtgaccggtactcgtatggcaaacggtagcgtattggccgagatcgagtttttcaatgtggaggcggacaagaccaccccgatccaattggaaatgcgtgaaagcaaggacgagatacaggtgatcggtaatttcaactccgagaataagttcaaacgtgcggacaacggtgaggagaccagcctgctagctactaccggacgtggctactatatcgtagcgcttctaggctcccgccaagaaccgacaaaccatgcgatgcgtgatatcgccgccgtgaagaaggaactagaagattggggacgaggcatcgtgcttctcttccctgacgagaagggctataagaacttcgatccgaaagagttcggcgatttaccgagcacgatcacatacggtctggatatcgacggggcgatccaaaaggagatggctacagcgatgaaattgcaaaacgccaataccttgccgatcttcttgatcgccgatacgttcaatcgtgtcgtatttgtctctcaaggctatacaattggcttgggcgagcagttaatgaaagtcatacataagctataacagatcgtttcacaagtgtgatctgatcttttcacccatgtgaaacgatcggatcacggctgtgaaacgttcttttcacataggtgaaaagatctatacgacaggagacactcatttcttctaccacaaaccgatcagacttcctccctagattcgttttaattcccttatttttcccgttcttcccaatcaaggattcatctctcaaaaaaataatatctttgattaaacctttttacgaaagggcagtctaaacttgcgtttggttatatattttggagtaacgagtgtaaattatcagtaaataccatacgagaacatgatgacaaagagagcgaaatggggagttacggcggctatcttattaatgatagcgggaatgatcgcttaccctcaattgaaaaacaagttcaaggcatcccaagatgccgcttccgtcgtacccacatcgggcacgagcctgcgaaaccagacacttaacatcaatgccgaggtattgaaataccaatcattaaccgataagatcatgagtaccggaagtacccttccggacgaagaggtggatttggctttcgagtcctccggtaaggtggtagccatctatttcacggaaggtagccacgtaaaggcgggcgatctgttggctaaaatcaatgacaagccgctgcaagcccagctaaagaagctggaagcccaagttcctttagccaaggatcgtgtctatcgccaacgtaccttgctggagaaagacgccgtcagccaagaagcctacgagcaagtagccaccgaatacgagaagctaatggcagatatcgagttggtcaaagcgaatatcgcccagacagagcttcgggctcctttcgacgggatcatcggacttcgctccgtgagtgagggcgcgtacgttacttcctcctcttccgtaatcgcgaagttgaccaagatatccccgttgaaaatcgagttttccattcccgagagctacgcggccgaggtacaagacggaaccccgatcctgttccgcatggagaaagacggtatgatgcagaactataaggcgaccgtttacgccgtggaaagcaaggtagatatggcgacccgtaccttgaaagtacgtgccacttacccgaatccgggcgagaatatcttacccggccgttatacctccgtcgagatcagcaagcgggagatcaaggacgctttagccatccccagcgaggccgttatccccgagatgggaaaagacatcgtttacttatataagaacggcgtggccgagcctcaagagatcacgatcggtatacgaaccgagagccgtgtacaggtattgcaagggttgaatgtgggcgatacgctgatcacgtccggcgtgatgcagttacgtaccggcatgaaagtttctattgataacttgactgaataaggagaagaacgatggcaaatatttcagaaaccagtataaaccggcccgtactctcgacagtgatgatgctggtcatcctcctgttcggctttatcggttaccggttccttggcgtccgggagttcccgagcgtagaccagccgattatctcggtcaacgtatcttatcccggagcgaacgccgacgtgatcatgaaccagatcaccgagccgttagaacagaatatcaacggtatcccgggtatccgttcattgagtagcgtgagtagccaaggcagcagccgtatcacggtagagtttgagttgtccgtggatatggagacggcggcgaacgatgtacgtgataaggtatctcgtgcccaacgctaccttccccgcgactgcgacccgcctacggtatcgaaagcggatgccgatgcctccccgatcatgcagatcgccatccgaagcaacaaacgctcgttgatggagttgagcgagatcgccgagctaacggtgaaagagcgcttgcagaccatcgagaacgtgagtggcgtggatatctggggacaaaaacggtattccatgcgtctatggctggacccaatcaagatggcgggttacggagtgaccccgatggacgtgaaaaacgccgtcgataacgagaacgtggagcttccttccggtagtatcgagggaaatacgatctccttatccatacgtaccttaggattgatgcataccgccaaggaattcaacgatttaattatcaaggaagacaacaacaacatcgtgcgcttcagcgatatcggacgtgcggaggtagctcccgaggacttgcggagcttactgaagaagaacggcgagccgatggttatgaccgttatcatcccccaaccgggagccaaccatatcgagatcgccgacgaagcctacaagcgtatcgagcaattacaaaaagacctgccggaagatgtcacgatcgagatgatgtatgacaacacccgctttatccgggcctctatcggcgaggtacaacagacgatctacgaggctttcctcttggtcgtattgattatcttcttgttcctccgtgactggcgggtcacgctggttcctgtcgtcgttatccccgtatcgttggtaggagctttcttcgtgatgtatatctccggattctccgtcaacgtattgacgatgttggcggtcgtgctctcggtcggtctggtggtagacgacgcgatcgtggtggcggagaatatatatgtacgtatcgagcaaggcatgtcaccgaaagaggcgggtatcgaaggatcgaaagagatcttcttcgccgtggtatctaccacgatcaccctgatctccgtattcttgccgatcgtgtttatggaaggtatgacggggcgcttattcaaggagttcagtatcgtgatcgccggttcggtcgctatctcctcgttcgtggcccttacgtttacaccgatgttggctaccaagctattgaagaggagagagaagaaaaactggttctatcggaagaccgagccgttcttcgagggattgaacacgatctacgccaagtcgttgaacgcattcttgaaccataagatatggtcgatccctatcgttatccttcttttcggatcgatcgggtacttctggaagaacattcgttccgagttatcgcctttggaggaccgttccatgatctccgtgaatatgcgcgggccggaaggggctaccttcgagtttatccgcgactacgcggaccgtatcgagcaaatagccgactccatcgctcccgagaagcaatccatcatgacccgctcgtgggaaggaggaggttcgctaaacctcatattaagcgatatcaaggaacgggaacgctcgcaaatggagatcgccgagaccttgtcgaaagaagtccgcaaagagaccttggcccgcgccttcgtacaacagcaatccaccttcggcggacgccggggcggtatgcctatccaatacgtattgcaggccccgaccttggataaactgcaagagttcctgcccacgtttatgcaaaaggtgaacgagagcccggtcttccagatggcggacgtgaacttgcgcttcaccaagccggaggcacgtatcgagatcgaccgggataaggcttccttattgggcgtcagcacccgcaacatcgcccagaccttgcaatatgcgttgagcggacagcgtatgggctacttctatatgaatggtaagcaataccagatattgggcgagatcaaccgccagcaacgaaatacccctgtcgatttaaaatcgatctatgtacgtagtaacaatggggaaatgatccagttggataacttggttaaggttacggaaaatgtggcgccgccccaattgtatcgctataaccgtttcgtatcggcgacggtttccagtggattgaataagggatatacgatcggcgatggtctggacgagatggaccgtatcgcctcggaggtgctggatggtagcttccgtaccgctctttccggcgagtcgaaagagttccgtgagagttcttccagtttgatgttcgccatgatcttggccttgttgatgatttatttggtgttggccgcccagttcgagagtttcaaggatccgttggtagtgatgttcaccgtacctttggctatcgccggtgcgctgatgttcatgagctattcgggtatcacgatgaatatattcagccagatcggtatcattatgttgattggtttggtggcgaagaacggtatcttgatcgtagagttcgccaatcagcggcaagagtcgggacttagtttgccggaagcgatccgctcgtccgcgacccagcgtctgcgcccgatcttgatgactagcgtatccaccatcctcggtttggtgccattggtatacgctacgggcgagggtgcccaagggcgtatcgccatgggtgtagcggtagtaggcggaatgttggtatcgaccttcttgaccctgtttatcgtaccggccatgtattcgtttatatccaccaaccgaaaaaagaacattactgaataataaataaacacatgaataagtacctatatacattactattggccttctcttccctctttatggcggaggcgcagcaactattcgatctgaaacggtgtatcgaaaccggattagagcagaactactccatccgtatcattcgtaacgagcaacagatcagcgacaataacgccacccccggaaacgccggttatctgcctaccgtagatatgagcggcggattcagcggaaatatcaataacaaccgtaacagcctgcaagacggatcgatcgagaaggcgaatggtataaacagcgagacgggtaacgtcggactaaacgttaactggacggttttcgacggtttcggtatccaagccgaatactctcgcttgaaagaattacagcgaatgggagaattgaacacccgcatgaccatcgaggatttcgtagccaacctttccagcgagtactacaacctgatccggcagaaaatccgtttgcgtaacctccgttccaccttggacctttccaaggagcgtctacggatcgtggaggaaaggtattatatcggctccatgtcccgtctggacttgcaacaggctcaagtggacttcaactcggatagctccaaggtattaaaccaattggaggtcgtgcatacctcccgtatccgcctgaacgagttaatggcattaaataatgtggaggaggaaatccagatcaaggactccttgatctacccgaacccgttcctcgacgaggtagatctatggaagaataccctcgaagccaacgcctcactcctgatcgcccaaaagaaccagacgttgtctgagcttgattataaaaaggtaaaaagccgctattatccctatgtcaagctaaacgcaggctacggctacacggcaaactggacggaagtgggcaattacgacctccaacaacggctggggcttaattacggcgtgaccatcggtatgagcctcttcgacggtttcaaccggaaacgtgagcaacgcaacgcccgcatccaaatcgagaaccagcaattgcgcatccaagaactggaacttgccctgcgtgcggacatgagcaacttctggatggcctataaaaacaacctcgacctatggagcctagagaaagagaacctcgtagccgcccaagagaactaccggatcgccatcgaccgctataaactcggcgagttgtctggtatcgaattgcgtgaggcgcaaaacagtctactggaagcggaggagcgtctttccgtggcggaatattccaccaagatctgtgagatctcgctgcttcagttaagcggacagatattaacctatatccgtcccgagccggagaaagccagtttctaggataaaggccagtgccacgcctatggcacaagttattataactccgtttaaagactagaggcttatgctaattgcgtttttttatgtaagttcgcggcaaatggcaaggtcatcattgcctaacgacaaaaggaaatgcaaatactaccaaaggttaatacattacgaaaaggatcgctcttgtaccgcggcatccgctaccgtaaaggattcggagtacattcgcctttcgtttttaacctcatcacgaaggtcatcgaggaaaaatgttcctattatagtttctatgatatagagcttttacgtaagcagttattattccgggaaggagagatcacctatccggaccggcagaacaaggggaaacgaaagacccgttccatcggcgagatcgtaaaacgggaatccatccggcccaagcatggcgccttattattccgtttgacaaactatttcaagtccaagaatatcctccagataggaaccacgatggggttgtctaccttatatctaacctcctatgccacgggattgagatgtatcgccttggaaaatgtaccggaattcgccacgatcgcccgtcaagcattcgctaaagagggacgtaatcccatcgatttgcgtatcggtaattataaggacttgcttccccaagccttaaatgacataaatagcttagattttgtttttttcaacactttatatgaacaacataacaacctctggctgtttaatgaatgtatgaaatacgcgcacaacgacacggtattcgtttttgagggaatcaaggcgagccgtaagatgcgtgaactttgggaagagatctgcgcatgtccggaagtgacggtcaccttagatctttactcgctagggattgtcttgttcaacaagaaattgcacaaacgagattatattgtttatttttaggattcaaaacaagtcagatatgaagaagagtattatctataccagaacaggcgataaaggaaccacttcactggtaggtggacaacgcgtgtcgaaagcgcacgatcggatcgagagctatggcaccgtagatgagctgaactcctttatcggattattaatcacggccttgaatgatgagaaagatactgatttcttatcattcatccagcataagctattcacgatcggttcttacctagccacggatcaagcgaccacggaattgaaaatcgagagcaaggtaacgcccgagagcatcgagcgtatcgagcgggagatagaccgtctggataacgagctgccgaaaatgcatgcgttcatcctaccgggaggatgccgctcggccgccctcgcacatgtttgccgcaccgtttgccgtcgtgccgagcgacaaatctatcgcttggccgagaattgccccgttgaggagcctgtattgatatttatgaaccgtttatcggattatttcttcgttctggcacgaaaagaatgcataaataataacggtaaagaaattatttgggattatacttgcgtataataaataaagtcatattttcgcggaaaaatagagaaccaaatcgcttcggcggttattaatacttgacagctatgtattggacattagagttagcttcaaaattggaagacgcaccctggcctgcgactaaggatgaacttattgactatgcacaacgttctggtgcgccattagaagtgattgagaatttgcaggaaatggaagatgaaggcgagatttacgaatgcatggaagacatctggccggattatccaagtaaagaagacttcttcttcaacgaggaagaatactagttcaattgagaattggaaattgaaaattaagaaatagaagaacgaggtggcggacgatcgagctcccctgcctcgttgtttttttgtgaaaatacaatttatccggatttgctgcgtttgtagttacaacgtgaagtgaatgtttaaatgagaagacgtcttctttcgatcttgatccttttgtgtacttgtgcgggaatcgtacgggcgcaatatgacgcacgcttaagtcaatacttcatggcgaaaccgtattataacccggccgtggccggagctacggaggacttgaatatattggctctcgcccgcttggaaatgatcggcgtacatggggcacccaagtcgttcttcattaccgcggatatgccactcgctttaggcaagacgaatcacggtgtcggattggttgtatttaccgaggcaatcgggcttttccagaatacgcatgtaggggcgcaatacgcctataagtataaattattcgggggagtcttgagcggaggattacaaatcggcttagtcaaccagtcgttcgacggaaccaaggtgataaaggttgagtccgagtaccatcaagagaccgacgcagccatccccgtagagcaggtcagcggcatggggttggatatgaacttcggtatttactatacccataaacggttttacgccgggtttggcatgacgcatatcacccaaccggagcttcaactggacgagaacgcctatacctatataggtcgttcacttaatttaatgggtggatacaatattcaattaaagaatccgttgatagaattacagccctcggtgttcttgctgacagacatgcaaagttttcatgcggatattaccgctaggctggaatataataagatgtttaatggtggtttttcctatcgggtgaatgaatcggtgggcatcatgttcggcgtaaagctaggtcgtttccatgcgggttacgcctttgatttcccgaccacggccctaggccgggcaagtagcggtagccacgagctatgtgtcaagtatgccttaaagctgaacaagacgaagacagggaaaaatagacataaaagtgtacgtatattatagtatatgaaaaaagtattattagtacttgtaacggtagccttgcttacctcctgcggtaaatctctccggagtgccggcggtgaggtgacaggtgtcagatcggtagcgttcaatgaacctgcgccgtatggaatggtcttggttaaaagaggttcgttcgagatgggtcccgccgacaaggattccttgtggggaatcatgccggagacgaaaggggtctctttcgacgcgttctggatggatcagacagaggtaacgaacgccaaatatcgccagttcgtttattatgtgagagactctattatccgtgaacgcttggcggacccggcttatggaggcaacgatctgttcaagatcacggaagaccgttacggggagcctgtcactccgcatttggactggaaccgtccgattccttggagacgggcgaacgaggatgagcaacgtgcgatagaaagtgtctattacacgaatcccgttaccggagagaaaggtttggaccctaaacaaatgatctataaatacgagtggtacgactataccgccgccgccctccgcaagaatcaattgaacccggcggaccgggttcgtaatacggatattcaggtagatccgaacgaggtagtcatgatctccaaggacaccgcttacatcgatgatgaaggacgtgtaatcaacgagacgatcacccgcccgttaagcagcgaatgggatttcttgaatacccgtatcgtcaatatctacccggacgagaattgctgggtgaacgatttcaagaatgcgtacaacgagccatatacccgtatgtatttctctcatccgggttacgatgattatcctgtagtcggtgtttcttgggaacaagcgactgccttctgcgtatggcgtacgaatttatacaaagaatccttgagcttgccaccgggacaattggtagagccattccgtcttccgtccgaaggagaatgggaatatgccgcccgtacaggtaagaacgagaataagttcccttggtctaccgacgagcttcaagacagcaaaggttgtttcttgggtaacttcaagccgggtaaaggtaattatacggaggatggccatttgattacgtctcgtgtaggctctttcgccccgaatgagttcgggctatacgatatggcaggaaacgtggcggaatggacctcaacgtcttactccgagtctggcccgagccaaatgagcgacatgaacccggatctgcgttacaacgccgccaagaacgatccctacgccatgaaaaagaaagtagtgcgaggaggttcttggaaagatgtctcacaatttatccgttcggacatgcgtactttcgagttccagaacgagagccgttcttacatcggtttccgttgcgcacgtacccaaataggattctctcgctccaagggaaagaaataagcgggaattataaatttaaagttttgaatcatttaagacaataatacgacgatgggaaaatatagaagatataaaaacagactggagatgttcctctccagcgaaagaggaaaacgagtattgaacttcctgtatagttggggtgcgtccatcgtaatcctcggtgcgttatttaagttattacatataccatacgctaaccaaatcctgttcgtggcgatgatcaccgagtctatcgtattctttatctcggcgttcgagcatccgaacaaggagtatcattgggaagatgttttccccgtattgaaatcaaagaacccgatggatcgtccggatttcaccggtacgccgatctcaaccatgatcaattctacggataatgtagaagacgatgagatagccgggggaataaatatcggttcggcagcgtctaaggcgaacgcgcaaagaggtggttccttgaatatcgcaggtaatctggacgtgacggaagaagataccaagaacttatccgagagcatcaagaaattaagcggagcggccgagcaaatttccaagatggcggaattgacggaagctacccaaaaatatctggagcaattatctggcatgtctgagaacatggagcgtttcagccaagtgactaattcgcttacgaacgtatccgatacactgttgaactcttataagagtatcacggataattccgatggcatcaaccaaaactcccgtggttacgtacaccagatggaacaattgaaccgtaatgtatccggattgaataccatctatgagatccagttgaagagtatcagttcgcagatcgaatctatcgaacacatcaatagtggcttgaatcgtatccgtgagatgtatgacggatcggtggtagatagttccgtattccgtaacgagacggaaaagatgactcgccaactggccgaattgaaccaagtatacagtcgtttattgcaagcgatgaccgtgaatatgggttatcagcagccacaacagcccagttaccaacagcaatatcagcaaccctatggttaccaacagcaacaacaggctccgtatacaaacaacccaatgaagtaaagaaatatggcaggaatatcaaataatcccaattctccccgtcagcggatgatcaacctgatgtatctggtgttcatcgccatgatggcactgaacgtgtcgtcggaggtgctggatggttttgagttggtggaaggtagcttgcgaacctctatcgataactcctcccgccgaaacaagattgtagcggacgagatggaagcttattaccaagagaatccccagaaagtgggtgagtgggcattgaaggcccgtgaggtgaaaagagcctcagatagcctctatacgtatatacaagatttaaagatccgtatcgctaaggtagctgatggcgagaatgccaacgtaaacagcatcgagcataaggatgatttggaagccgcctcccgtgtaatgctctctcctgtaagcggagaaggtaaaaagctgagagcggaaatcgataagtatcgtatctggatgggcggctttatcgaagattcggcgaagactgccgtattggaggcgaacctaagcacgactccccctcataaagcggggatcaatacccgtacttgggaagaggccttgttcgagaatatgccggtagcggcggctgttaccctgttaacaaaaatgcaaagtgacgttcgctacgccgaaggtgaggtcttatcgaacttattgaatagcgtagacgttggcgattaccgtgtgaaccagatcacggcgcaggtaatcccggaaagccagatcgtaatgcgaggaagccagtacaaggcgaatatcgtattatcggcggtagactctacgaaacgtcctacgatctatgtaaacggaaaagaattaccttacgagaataaaggagtcttcacggtgaataccggagctgccgggacattcccgatcaaaggttatatcgagatgccgaatagcgacggcagcatcatgcgccgggatttcgagagcgagtatttcgtgaccgagccgacagctaccgtggccccgacattgatgaacgtattatatgccggtatcgccaacccgatgcgtatcgccgtcccgggtgtaccgagcggtaatgtgacagctaccatgacgaacggcacattaacccgcagcaaggatggttgggaagcccgcccgtctaaagtagggacggaagccgtgatcacggtcaacgctcgcatggcggatggccggaacatagagatggcaaagactaccttccgcgtgcgtgccctccccgatcccctaccttatatcgagtataaggatcaaaacggtaacgtccgtaagttcaagggaggtatgatcgccaaacgtagtttggtagaggctgacggtattctggccgctatcgacgatgatttgctaaatgtaaaatatacggtattacgttttgagctgactttcttcgactccatgggtaacgctatcccggaagtggccgaaggaaccaacttctcgcaacgtcagaaaaactatatccgcaatttaagtaagggtaaacgtttttatatcacccgtgtagttgcgaaaggtccggacggtatcgaacgtaccataccgactatcgaagtaatcgtaaattaagattcgcagtatgaaacatctgtattacatagccgctttggccgccacttttttaacagcgatgcctcttcatgcgcaagaagaagttgagaacgaagctacgcagcaacaacaaacgcgtcgccgttcgcctcaagccagccgtggggaaagaaacgataagaaagataccggtttacccgaactgaccgtacgggcccaagatatgaacgagcgtttgacgcaagagatcgggaacgctcgctggatgcgtattatctaccggcaggtggacttgatgaaagagcagaacgctccgctttattacccgacccgcccgatgaacggacagatgaatcttttctccgtaatcttccagcttttaggtgagaacaagatcaaggcttatgagtatctggacggatacgaggaatttgacgaagcccatttgatcaacttcaaggatttgctggatcgcttctacatcctttatgaggagataccggggagagcgggtgaggaaccgactttcgtaatcaatgaaagcgatatacctgcagccgacgtgcggtcttactatgtaaaagaagcatggtatttcgaccagaataattccgcttttgatgtcaagatattggcgatttgcccgatccttacctctacaggtgatatgggagagacaaccatgcctatgttctggctgccttacgagaacatacgtccgtatatcagcaattcatacatcatgacgtctaatatgaataacgccatgacttttacgatggatgactatttccgtcgccggatgttcgagggggatatcatcaagacccaaaacttgatgaatctgccattgcaggcgtattgcccgacaccggattccttaaagaacgagcaagctcgtatcgaaggtcaattaaccagctttgagaaatcactctggtatcaaccggatacgactcaagtagcggtagacagcaaagccgcgaagaaagcagccaagagaagtgcccggaaagacaaaggctccaccaaggaggccgctccagagaaagctgctaaagtaaaagcgccgaaagcagagaaatctgcccctgtgcgcagtgtacgacgcagaagataaaaagaagcacatatgcctgtcatagagtagaatctatgatagctaagagagcctaatctatgataggaaagagaacctcgtctctgccttgccatagattaggctctcttacatatttctacttagaacctacccatgtccatttatgccaaataccttccaacggcccatgtttatgtctttctgcccaccatttacagaagcgtacttgcaagaagaaaaagacgataccgatgaacatactgaccgtataaccgcagtaaggagccaaattcaagccgatcgggaaatagatcaacgcaccgaaaaaggattgcgacacgtaattcgtcaaactcatcttcccatacgagcgcaagacggaagtgaaacgcctaaagccctcccattggtacagtaacacgaaagaggagaccaatacaaacgtgaaagcgaatttctgccacatatcaaggacgaccccggctgtctgacgcacgatagcgctatccgccgtatccatcaacaatactttcagttggtataaaggaccgaaagcaattgcggtaattatcaaagtctttatccaaaaacgggaattctcctccgaggagataaatagcttcctgcgcccgatcaacattcccagcataaacaacccgcaggtctgtacataccggccggcaccaacagcccagagcaaactagccttttgtcctaacgtcacgttctgccagatgaaattccataaatccccccgcttggtgtgctccgccatctctgagtacatctcccctactcctaaattgggtaattggtaatccggattaaacaggctagcgatataatgataccactccaccggctgcaataaaaagataatagccgttatcaagacagccttatcgctccatttacgcacgataaacaaaacaacgcccacgatcgcatacagcagcaaaacatcgcctgccggataaaaagcggcgttcaacgtagcgaagatcgtcaacagcagtaatctccaaaggaagcggtaaccgaagtcttttcccttcgcctgctggttcgaatactgtatataaaaggtaaaaccaaataacaaggcaaagatagaatacgatttcccggcaaacaaagcgaataccaccgtaaacacgccttcattcaatacgttcaaccatcccggcagcgtagccgggtccggatagaccggatagataaaatgttccacattatgcactaataagattgccaagacagcgaatccacgtagcgcatccaccacctctacacgaggtgacttagagattgttgtttgttgcatactatttatttgctatttgttgtttctgttaaccatgctaccttttgattggactcatgcggttggccgataatatccgcataaagttccggacgacgggcatttcggtaacgatatcctccagcctgtctcaatttctcagggatagccgtagcgatcacgaaatcatcacccagtttacggcattccgccacgatatcgccgaaaggatccagaatcatcgagcaaccgttcttgatctcattataatcacgcccgatcggattggagaataccacatataccgcattgtcgtacgccctagcgggaagccatttcataagccaagcacgtcccttcaggccatcgaactcctgtcgcaaggaagtcgggtcgtttgcccggttctcccataacataggatttatcaaaccagccccggggcgaggggaaggggtacacatcgtcacgtgaggcatgaaaatgatatccgcccctaataaggccgtggcacggacattctctatgatattattatcgtagcaaatcaatatgccacatttccatcccttgatctcaaaaaccacatattgatcgcccggcaagatattcggattaataaacggatgtagcttgcggtactttgccttcaagccattgccatccacgcaaacttgcgctttatagatgcgatccccatcccgctcaaagaatccggccagtagcgtgacgccaaactctttggcgatggcgatcaaggcttgcgtactctcccccgtggggatcggttcggcaatagccaacaattccttgcgagacaagtccttggcaaacgtatatccacaaaccgagcattcgtggaaagccactacatccgctccctctaccgacgctttccggcacatctcccggatgatagaaagattatacactttatcgttatcccgtgtctcgaactgcacggtggcgattttcaatggttccatgatattttgatttaattggtttatatatttttcgactagattcgcaaagataacaataatatactacttttgcgggataactttttctaccgatcatgaatatcagacaaacacgacaagaagatctggccgagataatggctatgtacgattatgcacgcaggttcatgcaagagcatggcaacggcaatcaatggatcaatggatatccttccgaggaattgatctccaacgagatcaaggccagccatagtttcgtatgcgaaaatgagcagggcgagttagtggggaccttttgttacatcgagggaatcgaccctacttacctaaagatctatgaaggcgaatggctgaacgatgagccttatgccgtgatccatcgcatggcctccaacggtaaacagaaggggatctccaccgaatgcttgaaatgggcgttcgctcattgcgataatatccgtatcgacacgcaccgggataatatcgtcatgcagaatttattgaaaaagcatgggttcaagcaatgcggtatcatttacatctctaatggcacggaacgcatcgctttccacaaaatagtaaatgcaacaaataaagaatcatgaaacatcctattgacctagaacattggaaccggaaagagcatttcctgtttttcggttccatggacgaccctttctttgggctgaccacccagatagacgtgacctccatctataaagaggcgaaagcggatcatgcctcttttttcctctattccttacataagattatgacagccgttaatgaggtggaagagttccggtaccggatcatcgacaacatccctgtctgcttcgaccgaatccacgtgggaacaacgattgggcgagaagacggaacattcggcttcggcttcttcgaatatacaccggacaggcaactgttccttcaaaacgcacagaaagagatcgaacgtgtgcaagctctcacaggcctttgcaaagatagggaatctgaccggcaagacctagtccgtttctccccggtcccatggatcgccttcacggagatgaaacacgcttcctctttccgtacaggcgattccgctacccgcatctccaccggaaagctgatcgagcagaacggacattggatgctccctatctccgtaacggctcatcatggcttgatggacggcagacatgtgtctatcctcttagatcgtatagcggataaaggttaaagacttagataacaaacaccctcgcccttagaagatcgaccatttgctttttaagggcagaggcattcaatggcttagaggcataagcatcgaatccgctattcatgacctgttcctcgtccgacgcaaaagcataggcggtaacggcaatgatgggaatgacttcggagagcttacggatttccttggtcgcctcatatccgttcatttccggcatattgatatccattaatacgatatgaggctcatattccttaaacagctccaccgcctcctttccgttccaagcgtgtacgattgtgtaatcattcttcagtatagtctcgaaaagcttgaaattgccggcgttatcttcagcgataagtaccgtcaacttatctttctcaacctttatcttctcaaaaatgacatcctccctcacaggtttctccggcgctttgtaggggaaggtaaaccaaaacgtactacccttcccgatctcagactcaacgcccatctctccccctagatgatcgacaatcattcggcagatagaaagtcccaaaccagttccttgggcgaaagaatccaacttcacgaatcggtcaaatatcgcttcttgttgttcaacggagatcccccggccggtatcagagacatagaagcgcagcatctttttatttaggcaagaataaccgtagcttatagagccttggtccgtaaatttaatggcgttagtcaaaaggttgatgataacttgcatcaaccgattcttagcgatagatacataacaatctttctccttacgctcaaacaccagacggacattttcatttacgacccttttactcatggaacgttccagatcggacaataaggtattgacatccacgtccgaatacacgaactccaaggtcccagcctctatcttagacaaatccaagatatcgtttatcaattggagtagcaacgcattattattctcaatgatctcggcatattcctgtttttcctccaacacgtctgtctcggcaaggatattggagaaacctacgatagcattcagcggcgtacgtatctcatggctcatattagccaagaaggccgatttaaggcgattggactcctccgccttgtttttcgcctccagtaattctcgctcaacctctttccggtcggaaatgatcaaggaagaaccaaccaacgtgagaggtttcccgttctcatcctttttctccacggcggcgcaagcttccacccactccagcccgtgcaatcctttattcggattatagatccggtattcctcctttatcttattcaccttaccgaggataagtgactcataagccttccttaccttttcgcggtcttccttatagatcttggagaaatactcggtatcgggaaccgtcagctggttctcgtcaaatagtccggagaaattcacgttcactgccttattcacgtcacaaagaatcgtatgctgaaccaagtcccacttccaaggagtgacattcgccacgtccaacgacatggacagtttctggttcacggtgcggagcacttgctgcgtcttcgctaattccgaaacatcaaccataaaaatatccacacaacccggggtattcgctgatatgatcaaaacattgaagtaacagtctgtcggcttgtagtaatattgtgtatttatttttttattttccgagaaaataagatgacaaatttttaaataccgcgacatttgcaacggatgaatttccgagccttttttccctatataagatttgtcacacttcaataaagcctccaatgccggatttagctctaaaataacataatcagtgggatactctttttcatcgaataggatacgttgtttcatatagcaaataggcatactattgaccaatctgctataatttcgcataaacattatctctttctcctgatacaatcgaatcctattcaatgaccggatcctcatgaacacaacaaaagcaataaataaaagaacaccgatccctgcgttaacataatcgccatattgttcccaaaacgtaggaggtctcatatagaatatcgtatccgcaggataacctgacgaaaacatccccctatttaccaagaccggatagtttaatactggatggggctgatacggagttataatggtattgaatacttcatttctcaaaagtccgttaatcgtgttaataagggtattggaaatattcgacgcagggaagaaaaatcctcccgccataccattctccacaatatccatatcattcaaggtaaagacaggcagatccgtatacgaactgatcatgcggtaggtatccgaacttaacacctctttattaccttgtgtatgtaacaatatccatgagtaatataatatgcctgtctgtttgtccgcattttgcagaatatctatcaattcatcagtctgtatatcaccggcagtgaccagttccaatttgacatccgggaaattattggttatggctttatgtatggaattctggttttgcgcactaatataccgcttatcagaaagaaataaaagtcgacgcatatccggattcgcttgcttcataagggaaactgtctccatgatatattccggcacataaataattgtcaattctctctcggtctcgacaatatccgataagttctgtcgttctggttcaggacaagcttttttggaaagataatattcccggggagctagatagtccttctctacgcaaaccaaataagataactccccaccccatttctcgttgagcctgtcttttaacaaagcgtatgagctattacctagcaaaatgattaatttaggggccttcttatatttgtccaataaatataaggtaaaatcttccacgtccttctcatttttcatcagcatcacatccatatgctccgtataggcatcaatatcctcattacccgctaccatacgttcatagatcggagtcgtaaaaatacggctccaaggcgtggattccgtataagaattaataataaggatatagtccgcctgtccgttatttgatagagccaagcactgggatgagataagtatcaacaaaattattagcaaaaagatagatttatggtaaccaccctttaatatcatgacctcttatttatttatactacaaatcaagaaaatgagtcaagctttatgcatattacccggctctaataaagatcgttcaaagatacataataaatattaactactacaggataaggcacataaattacgctactatccgtgaaatagcttttctatcgatcgatgaattaagctttcacttacatcgaaccggaataaccattcgatgttttccttatgaatcagatccattaaataaacattaattctttcccaacactttttagcgagaagtttttgttccgatcgaaacgttctatgaacaggacgaacgaacggatcattaaaaaattatcacgatggaaagagaaagagaacaaggttctgaccggcttgacacggaggaacgcaaagagttgaacgactctgatttcggattacccgaagaacggaaatatcctatgccggacgccacacacgtacgggcggctgaatcctattttcgatacgctaccgatcagcaaaagccagaattggctcgtaacatcttgagaaaagccaaagaattcggagttgatgtcgaaagtccgacaatcttagagtgggcaaaccgatactgacacccactttgatctcttattcaccaatataaccgtatgtgtttggtagcacatacggtcatagcaggttatttacgcacctgtaaaaagcgttttgtcaaatatctgcgaaccggctcgtcatagagtttcaaactaatgtaagccaacacgatactgccgacaactaatgccaccgcctccggccatgcttccgcgaatgtaaggttctccttcttcacccacccaaaatacaagtatataagtggataatgtaccatatacaaaggataagagatatctcccaagaatttacagatacgggcggaatgcttatcggttgttttcccggaagcccccagataaacaagcatagggaatattaggatcgcacatacggaatcatagataccgttcatccataaagcctcgccattaccgacatatggcatggagagtaaaacgacgatcgccaagctgcatatccaaaaagctcctttgacaggaatgggcttaaaaacgcgcgacattaataatccgatagagaaagaaaataacacacgcaagaaaccaccgatcagattgtattcttccatcgtccaccccacacccagatggcccgcaccggaaaaattgaatatagcgaacgaagccaatccgattcccgccaacacgacaagcgccgtaagcgccttcgttgacatccggcgaataaacaacgcatacataatattcccgatatactcaaagaacaaagaccaactaggcccattcaagggatacatctctccattcccgcggatctcaggcccggagccgggtacagccggtatcaaaaaaaggttgataagcaaagctagcatcaccatggatatggagacctgcgtaccatcccacttctcacacccttgtatacaaaacgcgataactcccaaaacagctccaaggacaaccatcggatgcaaacggatcaatcgacgtttgataaaatcctttgtcgtcatggttttccaccggtcgtcataggcataaccaatcacgaatcccgataggataaaaaagaaatcaacggctaaatacccgtgattaaatcgttggtcgataggactcgtcgcaaaggcttcgaatacatgataaaatataaccattagcgcggcgacacctctcaatccatcaagaaggtcataatgaggttttgtgtccgcaaatgcggccgctgagatttttgagtttgacattaattgtttgagcttatttttgatactactattactcctaatttccgcaaaaatacaaaaaggccccatctttcacgttattagacagttcttttttcattagttacacataaataaggtcgcaaaatacgaagtccccagcaaagcttacgcctgccggagacttgtttctttatccgtactccatcctcacggaggtacttacggacctcttaatttattactttagtattaatattaatccaactcccgcctgttcatccgtcacggattacttgggatcgaaaccctcacgggaattgtcgattatcttatttcattattcctttactttgaatattcaattatttaacgacaactttcacagtctcctcgccaaccgtaacgaatacgataccggcaggtacagcgattgtagcgttatcggatgtaagaacagtctcagctacagactggcctaatacagtacgtacataagcgttctgaccagcagcgccttggatcgttacgacaccgttgccacctactacaacgatagaggaagctgcatcttcaacagaaccgttagaagtcggaacgtcagtacctaaagtgaagaccatagcgatatcattgtcagcagtcaaaccaagttttccattcaaggcataaacataaactgtcttaccatcaatctttctttgagaagaaataacatactcatcctcagaatccttagctaaagttatattaaacttgaacgcatccagtctatcagaatttacagtctcaccatcagactccaattccttaacaacttttacagcctcaccatttacggtagtagcgattgtatcaacaccctcaaggatagccggacggaagattaccttagtatcctctgttccttccaaataatatgcctcatttgtatattcttgagcagagccttctacgaaatatttcaaagaatcctgagcattgaacatgaacattctctcagccggtgcttcttcgccttcagcaacctcaatgcctttagagatatagaatgaaggagtcttagccttgctatccgccgtatccaaccagaaaatcatgctttccgcagaaaggataccttcagtgataccattcttattcaactgatagttgatagaacctaacatattgtcaaatgatgcgtgacgtggttgagaggccaatgacgggttgaacggattagcgtccaagatctcaacgtttgcgtaaccatcattcaagtcactagctgctacataacgcttcttatcataagctacagttaaatttgtgctattaacgctcgcagttttaaccgcagaagtattatcaattgaagcagcataatcaagcgtaccctcagaagtcgcagctaacgaaaccaaagaataaccgcctgcggcattcttaatgatagcgaactctgtagcggcatccttttctttatcagtagcagcggcagcacctaaatatctagcatcgtcacccttaacttccgtcgtacgcaagatataagttggaacaaccaaagtatccttatccgcaactcttacaacctcattcttatcatttaagtaagcataagtattcgtattcaagatgtaatcagctacaccttgcaaagatttatccaaaatttcagcaccttttactctttccggataaagggtcaacattgtcgccttctcatcggtagagaccttcatactctttttatcattagaaagaactgcataaagagtcttgtcaccaaatacgttcttaccattgaatgtcatcttaaagccctcggcgatctgagtatccgtgaatactttataaccgtccgtacgagttgtagcgatcgtgttgaacttaacggaagttgtattcagtgctaaatcttctgttacacctttggaagctttttcatctcctttgattgttacttcttctccatcataagttgctttatctactttatagccaccttcttttccatccggttgtaaacgtaataccaaatcctcacctgtctcacggtttgtcaatgtaaaattatatttgccatcaaaaccagaaacgatccattgggataccggcatcgtaaaatccgcactattataagcaaccactcttaaaccgtcacctgtagcaggatcaaccgttaaatacttatggtactctgtttgagcgtttggcttaccctcagagctcttgtcctcatcattacttgtaaagtaaatatttaccacattctcagcgttcttcttcaataatacagaagcgtcaagataagaattcgcacccagttgcggatggataggagtatagttcgtttttgtacttcctgataatacagtagtcacataagtcttcgtatcagaaacagaaggcttaaccgcagctacatttacatcataagaattccaagtattaccttctttgacagaaggtttcatcgttaaaatcaacttaccatcctcattaaaggcatctttcaataagatcgtaaagcttgcgtttgcactagagtccttagcagcgacctcacctttcatccaatacaaagcgtaaccttcaccatcttgtttaccattgatgttgtaacgttgagtaggatctacagccaagaaagagatttcttttgcagctgatatggcagcttcattatttgtaccatcttcaacttcagcaacaaatgcttctaccttctttgcgtcacctttcacaaaataagtacctgtctggattttcgcatccgtagcagcaatctccgcactaacagttaccggagtcacggcatcaaacaagttaccaaccaattcgctagtcgtataatcgaaggacaaagttgtaccttttgaattgtattcagtcaaatacttatctccgatctcttcagcataagagaaggcctgtaaattactaccaacctcgctagcaggcaatgcagccgtaaacaagcctttaaatttcagcttaccatcttttacaataaacttcgtgttgaagtctgaaagatttttcgttgactgatctccggtaacggcagtaccatcgctctttgttataacttggtattccttaccatcaatagttacccacaactcgaaagtacgagaagagtagttacggatcgtaaattcggcggcagtttcatttgtagcagaagcagttgtagctgttaaagaaacaacttccttatcgcccttcaattttaagatatcactactcgtatactttgcatacaaagtagtatttgacgctcctaaatagaatgtcatgccattgcccaaagcggtctctgtagttgtataagaaacaacggtcttgtctccaacagcggcatacgcagcattaaaagcaggtccacctagcagtaaaccagctgttaacaaggtaaaaatccttttgttcataaattcaaaatttaatattaataatagtgttaattaaagtccatcccgtcgtttagcacccttgttttacccgaaaacgactagtctaaacgatcgtctagatcttgcgttttttaagggggtaaaaagaatggttcgtgaaaggaatcggcagtttcgtaacggatagcctatttgattgataagaaagaggataaggggtgaaaaaaatagctcagaagggttgcaagtatcgaagaaatgcgtacctttgcaaatgactaaaagaatcgatcgtttaaactagtcgtttatatcccataaaagattgtcaagcatcaaggtttttaactatatataatgtacaggcgtacattaaaataatgtaaacctatcaaagcataagatctgaatcaagcttcctctttgacacaaaagtactgatagtaccgctagcttcgggttataggtattttataggttcacccgataatcattgggggtatcttcaggctcatctatatttcagccggcagcctaagacaagtcgacctacagaaatatagaagtcggccaacagatgagatcatgggataaccattgccatataaatcgctgtcttatatcctgttaatcaacaggccaactcacttgagaaaggtttcccaagtgaataactaaccacttccagactcgtaagcttacggctacccccagccgtaagttattcacttgacaagccgtaagttattcacctgacaaggcataaattatacattaagcgtctctcccccgatggttatcgggaaatggcagaggaactatagatacaagtggcccatttgtctttttgacaacttgtaatctgaagtcccggagaaacgattattccgtacccaagtgcgtctcgcttccaaattcgagagaaaaaaacagcaattctctgtttgatagctatttgctaaaaaacggcctttcgttccagccgaaataattcaccctagttcatgttttacggtcgttaggcggtaataatgcccaacgctaccgtatgtgagggccgatgcctatatatgtgtaggcttacgccactatatgtgtagcttgacgcggctatatgcgtgggttgacactgctatatgtgtgagttgatacagccatatgtgtaggttgatacgtatatattcgttaaaaagcgacgcttatcgtgttaaaaagcggttgtggcagcttgttcgcgctccccgtttacgctcgttggcttttatagccagagagccgtgtcgtaaaaaagaaggtatttcaatcaaaaagataccattcatcgcattaagctgacatccgcaattctcgtcttatccctttgaattaagtctgtccccaataaatatcgggtgagcgtttacttgattaatattggtaatatatgaacgatgaatctacagaaaaatatcttgaggcaacgattcgtcagcaaccacgtcactggctcatagacaaaaaacgaaacggcagacatctccgccgtcccgcccaaaagagatagccttatctctgtttgtacacatgtcaaggttggttatttactgatatcagggcctatataaaccctgtttttcatatcgtgcgtaaacataagactttttttcgacaaaagagcagattccttcttctttttgggaatacatgttctaaacatgccacactacctcttggctactagcgtgagcttctattatagaggaactatgaaaaagcattttacatcaaaacataaagctaaatcctttcttctgcgaagcattgaaccgttcaatctccaaagaaagggatttctttaactgattagccataaatattaagaaagacctgcgtatgatgcaaattgctttcagtcggtttaaggattttctgaaagaacagtagccattatatgaatgtaacatcaagcccgaacttattactaaagatatgatggttctgtttgtagactatttgcaatcccgtagcgttggcgagggagcaaaaagtatctatcagcgtttcaagaaagtgatacgctatgccatcgaacacgatgtgatactgaaagacccgtgtaaagaagtaatttgcaaggtagacgaccaaatgttacggaaagatgtgctttcactggaagaaattcaggctcttatcaactgccattatgagaatgagaacccaatggtaagacgtgcctttatcttctgcctatattgtggtttacgcttctgtgatgtgaaagaccttacatataagaatgtagactactcaaacaagctattgaagtttgaacaaaacggtgaagaccgtgcagcctatggtgagcaactcttgaagaagctggaaaaacgactgaataccaaagggctgaatgaacgtcgattccgggagttcagacgtttgtatcttgtttatccacagttgaaagaagaggttttaggctatgttatgtcgggttcgggaattcggcggttgccgaccgccgaatttgaaacagagattcggcggtcagtaaccgccaaattgcaagtggtttcagaaatagcaaataatgactggaaattggctgcagaaaagctatttaacagattatcttctacgcatttgaatgcaatatctgctattgacaatcctattaaacgtgccttttatgaaatggaaacgattaggggatgctggactgtaaaagaactggaacggcagattgattcattgtactacgagcgtagtggattatctaaaaacaaagaagctctttctgcattagtacagcaacaggcagttcaactacagcctgcggatgtaataaatactcccttgaccttagagttcttagggttaaatgaacgggcattagttacagagaatgatttagagcaagccatccttgataatttacaaaagttccttctggaaatgggacacggcttctgctttgaagctcgccaaaaacgcatactgatagatgaagattacttctttgctgacctcgttttctatcaccgcatactgaaatgccatgtcatagtggatttaaaaattgacaaattccaccatgaatatgcatcccaactgaatatgtatctaaactacttcaaagcagaagtaatgcagcccgatgataatccaccaatcggtattttgctttgtactgaaaaaggagatactttagttcgttatgccacaacaggattagacccaaatatttttgtacaaaagtataaaatccagttgcccagtgaggaagaaatcaagagatttctttcaaaggagataggctaacaactttcaataaaaacaaaggtttagttcattttagatatacaagagaaatggactaaacttaatctgtaaccttttcattataaaacctcaaaaattccatttcacccacctgctttaaaaatttctgattttcaataaagtcttgcccatactttaaccaacgttttgtaaaacctttgaacttagtgcaaggaaatagatgacattggtagcagtgtgttattcctttctcaacgcaacacaggtaaaatgttctacatttttcacagcgggttttgttttcctctgctccctgacaatttttttcatctcgtgtgtagcttggacaaccgccacagaacacaccacaagcaggaatacgaccatgatatggttttattacagataaggtttttgccatccaaaaattagtcaaattcaatttatttgcctgtcgtttttgttccttcttcaccacgtatttttgcttctcaaagaatggacgagcagttagactcacttctgatgtgatttgtataataccttttgtaatagcatatcgttctatttcttccaaaagcatagttgcaatgcctttgccttgaaagtctgcgtgaatgaacatagagtacagatagccttgcggcgtaatggatgaaaaacctacaatctgagacagttgattaacagccacaataaaatagtgagtctttatcatttcctctatattggaaagatcatctccgcatgatgcccaatcttcaacttcatccggtgaataatcacgcctgtttactacaagcacggtattcttatataaatctctcagttcagcactatcagattgttgcgctattctgattttaaagtccattttcatctttggttttgtatcttttcgtataataccttattatcattaagggttaaaacatatatctgtttttccgaattatcgttaaatgcttcttcttcaaaacttccaaacttgtgaataatatcaaatccagcccgttccagatatgaatccaattcttgagggaaaaacatcctcatatccaaattctggattgaatgaaactcgccattgataaaatagtgccattctatgcgattgatttgggttgtactctcataacgcattgtttgttttatcaacacatcccgtccatcatccgttgtatattcggcaattactgcctgcactttttcgctctcgacaatatactggatgttgggattaaagcaatctaacagaaataagcctcctactttgagatgatttctaacgcatcctaacgcattgaataaatcttcgtttctgtataaatggtggattgaattaaatggaataaagattaggtcgaatttttcttgcaagtcgagcattctaatatctgcttctatgaaatcaatcactaattctgcttcgatagccttcatctttgcttgttcgagcattgagggtgtgtaatctactccgcaaatgctgtatccatctttggcaatggggatcgtaagtctgcctgtaccacagcacagttcaagtatttcagcctccttatttttcggtagccactttttgtagaattgcaaatcagatagaaaggtatttaatccatcatatatatttgcatcataaatcaactcaccaaccttgtaacctatattcatttatattctccaatattcattgtttcatgtttatataccaaacttatttctattctctttcgtgtccggatgggatagtgcgttaatgtcagccctactgatacattcattaaattgcaaggcaataatttaggggtctatcattatctcttctttgctatatttatcattattaccccattcggttttaagctgcgcataaattatatcatctacccaatccccacgcaaataatagctctccttaaagtgagcttcctttctgaaccccaatcgctctattaactggatagaagctgtatttctcggatcgactgaggctataatccgatgtttatcgagcgttccaaaaagataatcaactattgctttcaatgcttctgtagcataaccttttttctgataatctttatgtagtgtacatccaagttcagcctgcatattgttgtgattggtaaagctaattcccatatcaccaattaacctgttttcatctgcaagaataatggtaaactgaaaacatatattggcaatatccattgtcgccggcatattgctaatataatcacggacttcttcaactgaatcaggaaaccatccctgatacttatttttcgcaaagtcagaacggtaagaaaaaatgctttctgcatcttccggttcagcaagccgtatgattaatctttctgttttaatgggatatttcaccttgttgtttataaattcatgagttgagcaaagatacaaaaattgtctagccgtggatagtcctgccgaataattacatacaaaaaaagcttgactgattactcaatcaagcttttcaacttcagtacccagacccggtacaagccatagaaatcataggaaaataaaagaatttatctttcttattatcaatcacttgaatatttcctattttctctatttttgccatattttgcccattttccgttattcagtacacttttagtacactttgaaatatcattttcttttgtacctttgcaatatcggaaaacaaaagaaaatcaaccatttagcgtaatcacccggttatggtacctaaatcgggataaaacctctaaacaatggcaaagttagaaaataaaacgaaagaaaaccccaagttagagcaaaataagctctcggatggtagaatcagcctttacttagagtattatttaggtagagaggaaaagcccgtattagacgagaacggtaatcaagtgtactatgatagtggaaagatgcaaggtaagcccaagtttacagtaaagcacaacaggcgaaaagaaaaccttagcctgtatctgatagataaaccccgtacccctgcggaacgccagcagaacaaagaaacgttggagcttgccacaaagatacgtgcagagcgtgaacaggagtttaaagaaagcatgttgggctatcggttgaaaaaagatagaacggtcaatttcttagactatttccaagcctatatcaacagttataccaagaaagatattcgcatggtacaaattgcgcttagccgttttaaggacttcttaaaagagcaataccccatgaatgagtttaatatcaaaccggaacttatcaccaaagaaatgatggagcagtttgtagcctatctgcaatcccgaagtgtgggtgagggtgctaaaagcatttaccagcgtttcaagaaagttattcgatatgcgattgaccacgatgtaatgttgaaagacccatgcaaaagtgttacctgcaaagtggatagccaaatgcttcggaaagatgttctttctcccgaagaaatccaaaagttggcggcttgccattatgacaacgagaacccgaatgtcagacgggcttttatcttctgcttatactgcggtctgcgcttctgtgatgtaaaagaccttacctacaaaaatgtggattacgctaatcggttattgaagtttgagcaaagcaagacaaagggacattcagccagtagtggtgtggttattcccctgaatgatggtctattgtctatcattggtgaagctccggcagataaaaactgtttaatattcgatttgcctacttacgaaagctgctgtaagtcagtaaagcgttgggtaaagagagccggaatagacaaacatataagctggcattgtgcccgacattcgtttgccgtgaacattctgaataatggggcaaatatcaaaaccgtagccagccttttagggcatagcggattgaagcatacggagaagtacacccgtgcggtggataaattgaaagaggaagcaataaacagcttgcccgagctaaagttttaaccataaaagacttatctttgtaactatgaactttgaagcattagtgaaacatatcagcacgatacagaacacgttgcaggcacaagccgcacacgctgtaaaccttgcccttacttcccgtaactggcttatgggctgctatatcgtggaatttgagcagaacggagaagaccgtgccgcctacggtgaacaactgttgaagaagctggaacaacgactgaaaacaaaaggtctgaatgaacgtagattccgtgaatttaggcggttgtaccttgtttatccacagctaaaagaacctatcacacaatacattgcatcacaaattcaaattcggcagtcattgaccgccgaattcactgaaccaattcggcggttggtgaccgccgaatctgaaaatggtgtttggaaactatcaacagaatacccacaaaccgaaacatggatgattccagctgatagattattcaacagattatcttccacccatttaaacactatatcgggaattgagaacccggtaaaacgtgctttctatgaaatggaaaccattcgtggctgctggtctgtaaaggagttggagcgacaaatcgcatctttatattacgaacgcagcggactatccaaaaacaaagaagccctctccgctttagtccagcaacaagcaaccttattacaacctaaagatgttatcaatacccctgttactttggagttcttagggttgaatgaacgtgcattggtgacagaaactgatttggaacaagccattcttgacaacctgcaacacttcctgttagaaatgggacatggcttctgctttgaagcccggcaaaaacgcatcttgattgatgaagattatttctttgccgacctcgtattctatcaccgtattttaaaatgtcatgttattgtggagttgaagatagacaagttccaccatgagtatgcttcgcaactaaatatgtatctgaactatttcaaagcggaagtgatgcagccggatgataatccacctatcggtattctgctttgcactgaaaagggagatacattagtaaagtatgccacagccggattagacccaaatatctttgtacagaagtataggatagagcttccaacagaagaagaaataaaagagttcatttcttcctcaaactatgagagttacaaactttaaaattggcgaaaagaaaaaggttatttcttctttcgccagcatatactttcagtcaatagaaataggtttagttcgttttggatatatatacaaaagcacaaactaaactcacaataaagtggattaaaaaaagagaagatgttttgataaagtcaggaatctatttttgctttttgagagaacaactcacgaagttattctatatttcaattgtaattagtttatagtatgaaagattttaactcacaatatgccaaccattcgaaattagaacagctaaaacagttcattttggaacatggtacttatatcgaactcaaaaagggcgaacgattcactattcaaggcaaagtgaatcatcggggagcttatattgaacacggcttattgagatatactcgtgtggatgaaaaaggaaacatacacatagtaggatatactttctccggagaatttacgggaagtttatgtacacttatagaacctgagcaaccgtccttagttacaattgaagctgtttgcgatacaacgatttgttatatactctactcaaaggtggagcatttctttgccacaaatgctgaaaccatgcaaataaagtgtactcttgttgaacaatcatacttattaatgtatcatagattattggatatgtactgtaagactacagaagaattgtatcttgacttattgaacaaatgccccgatattcaagagtacataacactgaaggaaatcgcttcattcttaggagttactcctgagactgtcagtcgcatacggcgcaaattgaacaaatagcttacaataatgaaagaatttaactcatatctcaacaatttggactattcccttgtaaaagatttatttgcgagaaaagggatattgcgtacttaccataagaaagatttctttatccggcaaaatgaggtggaacgttttgctggatgggtaaaacatggcacatttcaatatacgcatattgacgaagaaggagaagagcacattgtgggatatgcttttaccgatgaatttgtatgtgactattcttcttttatgaaaagttgtctgtcagcagtgagcattcaagcgttaacagactgttttgtttatgaaatatcacgccatgatattatagaatgttgggaaacgaatatggaaactcaacgattaggaagatatgtagctgaaaatctatatgaaatggtgtatgaacgattgctcgattcgtattgtacacctgaaatacgatatcaaagactaatgaaacgttgtcctgaccttaaagatactgtacccttgaaaagtatagcttctttcttaggagttactcctgaaacagttagtcgcatacgccgcaaactggagaaatagccaatcttttaacatccattataccggggtcttgacaattgtcaagaccttttttctttattcttccgtattttgcattcatgatttaataacactgatatgatacgtaaattaacacaagaagaatataataatgcggctgatttgtcctatcaagtatatatggaatgtggcaggaatgatttcacccaagaaggtattgaaacctttaaaagtttcgtgtatgacacatcgttgatgaatacacttgacatatatggtgcttttgacaatcatttattgataggaataatcggtgtacatcaggaaaggcaacatatatccctcttctttgtcttgccacactatcatcggcaaggaatagggaaatcgctatttgactatatgatgagcaattgtaatttcacttatataacagttaattcttcaacctatgcagaaactttttatacatctttaggctttaaaaaagtgggtgaaaaagagattaataaaggtattgttagtatccctatgaagagaaatatataattattgtcaatcacttaaaatagagataagatgaaaaagaaaattactttatgtatggtgctttccacattcattatttgcgccatgttatgtctgacaaattgtagtaacgatgatgcccctacttctgtcttcacccccgaagccctgaagcaaactacttggcaagcgcaaatgaccgtgtacaatatcgaagatgagatagagtacacaaaacaatccattcttcagtttaccaacgaatcagaaggcatttatacaaggacgaacgaagaagacggatatatgtggaacacagattttacttatcaaataaatggaaaaatcatcacgttcgacaacatagcaggtccgtggacagtgctggaatacacaggaacacacctcgtaatggaagcctataatcccaataagatggtgtggacgttggagaaaacgtattaacctaaaaatagcggatatgaagatttcaacaattctctttttctgcctactaatgacagcttgtatgcagacaaaatcctttcaccggataaacggctggtactacgtaacatcacagactacagacagcctttcacaaacacctttccttactgttaaggatttcgatactttacgtttggaaactgaagcttttggacactcggtcattactggtgtcttcctccaagataaattgcctatatggagagaagccacagcaaagagtgtaggaaagtacatcgctttcgttttcaatgacacggtgataactgctcctcaggttaatagccccatagaaagcggatgtttccaaatttccaatccgcatggatatgatttggaacgtatctttagggaactacaaaaagaaattgatatatcaaggtttggaaattaaatgttaactggaaaatgggaacattaggttgcataaatgatatgctacaacgggacaaagagaaccgtgagcttcgcaagttgaatagagacaggatgaaagaacatcacaaatatcttgtaggcaaaggtaaaaatgctgatttatccaatgtttccattgaaaagatagaagaaatccgtaaaaaaaccatagaaaaggagcaatcagaccaaatatatatgtttaggatatatatatttcttacaatatgccttttagtgctatttttattgggattactttgctataaactatttttctaaattccccaaaaacaacaacttgcggattacaatattatgaattgaaataagccttttcctaagtcccgctaaggcttattttttatatgaatacatacatgaatcttattttagaacagcgatttttccgcttattgtcggaatattcacaacgtaaagtttctgcatcggagtttacagaagctattgaggaattggctacgcatgtagccgattttggtatcaacgaacaggattacagtattttacttcgctatttttcctttggtttacaccgtcttaaatcgtatcgtgtacggtttgagcaagaaaaaaatgccctatttgcatttaattgatgaagcgataggacttttgaacactgaaatacgccttattgaatggcgcatcaaatacccggaacaactacagcaacgcatcaataaacagcccctttcccctctccacctcgccgacaaaacaacccttatcaatatcatggaagtggtaagcggcttattcctctccaaagacatcgtttatcagaacggtaaacctgcctatttagtggacttatccaaaggttttgaatggttgtttaacattaagataagcgactgccaccaaaaacatgaggacgtgataaaacggaagccgggcaaactcaccgaatttcttaatggactggcaaacctaatcaaaaatgaacatgataagaaaggatatagataatcagcaacttatgatttatttataggggactccattagttctcctgtaatttctttgtatccgtttttagaactttgcttcatcaatcgattgacaaacaagaatgtataatctgaaacatgaagcaattatgtatatagacaatgacgaatttggtgaatggatgcagaagttgtatgccaaactggaagaactctgcaaagatgtacgggtactacgcaatgccgacagggtactgcccgaagatgacaacctgctggataatcaggacttgtgcctgttattcaaagtgagtatcaagaccctgcaacgctaccgggctatcggtgcgctgccttacttcactatcagcggaaaagtgtattacaaggcttccgatgttcgggaattcatcaaggaaaggtttagtattaccacgctacgccagttcgaaaaagaacactgtacgaagaaaaagaaatgaatctgaaaagccggaacggtagaatgtacttcatctgttccggctttccctgcttatggcttacccagcttatcggcttctttctttagctgttcggcttgctcgttcaacagccttgcacgttccagtgcttccgcctgcttttggatacgatattcaaaattcatcactgaatcggtcagacttcggataaaaccgttatcccgttgccacttgaacttgttttccaacatatcaaaagtttccccgtctgcctgtccctgcatcagcaaatagcggtatttcatatcgttgtcctgcaactgctgcatacgttcagccaaacggacattcaagaatatggaagcggaacagataaccagcactgccgaaaaaagaaacaatcctggacgaatccaagaagcgaccttgttgtaaatccgttgatagagcggtaagggcatagcttcctctttatccgtcttgcaagagcccaaagtatcaagcattaccttgaaacaacgataggtttccaatactattttcttggtgtcctcgatatgtttctgctgaccttgcatcctgttccttatctcgtcaagctggctttggatagcctgcaaatccttttcgggaacaaccgggttactgtgcaattccgacaatgcctgttcgattgcgttcagcctttcgagagtttcctcccgactggctggcgttacctgtgcttcctgcttctctttcagttcagtaaccattgagagaagcccctctaaaatcaaattttcctccatacgcttataactttagttgttttttcttttttttcttcttctttctcaaaaaggaatcatcgggcatttcatcagccggggctgacaaaccggaaaacagaccgcctaaacctgcaataaaagaattatctgctttgtcgggtgctgatactgatttctgaacaggtgcggtaaccgtctgcttattgcttccgactgtcgtctgccctacatccccaaaacatttatccagtttggagaaactgaaattacggtctatctccgaacccttgaacgtgtattcgcctttggaaaaggaaacgccttgtatctcgcccgtctgtcccttgtacttgaaccggatagtaatccccttttccgctaaccgctcctgtaactgctgccagtttcgggatttcccgatttcattctttacagcgttgtaaatctcgtatttcgatttgtccggctctttcaagcggtactgcttcacctgctcttttccaccagcaaaataaagcccgtgtttggttttcagtttcttgcacacctgttcattccggtacatatcgttcctgtccgaaatggtcttgccgttgttatctatgcgattgaacacgatatgtacatgtgggtgttcccggtcttgatggcgcacgatgatatactgcgtatcggtgattttcatttcacgcatatactcctgtgcaagctgtatcatcttctcgtctgtcaatttgggtgcatccactgccgaataacttagcgcaatatgtccgaccggctttttcaagtcgggattcatcccggtctgcatacagaagctgcggattatatcccccttgctttccgtcagaacgccgtccgcatggagcaaagccgcctgttccttgcccaacacatagtttacgcagcccttaaacccgcttcccttttttatttttccaatcatccgacaactggtttataatttcgacaatcctgtttttcagtttcaccagttccaccgccaccagtgcgaaacctccggcatttccccggtgcgccaactggttgatgttgttggcttcccctgccagtttgcggatggtgtccgcatcctgcctgttcagccggggtatgacctctgccgaaacaaccgcctgccggacatactcactgacacgcaacccggcttccccggctcgcttcctgatggcataatactgcaactcggtcaacttcgtactgactacccgttgctgcttctctatccgtttctttgccggacgtccccccggcttatcctttatattcgtcataggtttttacatttaaatggtatcttaaaaattgcgaccaacgggagaaattttctttgctgtcaagcaaagaaaggtagtttcggtaaaccgaaacataaccttgctctccaaattaaaccgcctgtcgttggtaatcctaccggactaaatacccctgccccttttcagtcttggggcggcacgttgtccggtttcctgctttatctcctgcgcttggctgatgctgttcttctgttcctgcttcctgccgcacaggtaatcgttcaagtccgaataccccctataattgtccgagaagtcacgcacacgataggagtattccaattcgatagcccgtgtcgcttcatatcctgccttgtcattgtcaagcatacagtggatgcgttcatacgggtacagcacgtcaatagctttcggcacattgacagtagagttgagtatgacataatcctgcctgtcaaggtcaggcatggtcgggcagttcttcatccggagcgtgaggaaagaaagatagtccataaaaccctcgaataccaaacacttctctctcggctctccctgctgccgtatatgggtgatgtctttcggggcgatgcagcccttaaaaaaggaattgcgaacctcgtaacctcctgccatgttcgggaaaccgatagcaaagaacggtctgccgttattggtaaaatggagttccttacattctctttttgccagttcgacattgataccccgtccctgcaagtaacggagcaatgccagatgggtaaggtcacggacttccaaatgttggaaactcggttctgccctacgctgaggaaaagaaaaactgaccgggcggacgtgcggtgtctgttccgctatccggtttaaaaggtatggcaggctgtcggagcaatagagttcctttgccagtgcaatgatgttgccgcccttgcctgcgccaaagtcataccaaaggttgcggtcagtgttcaccttgaaagacggttcgtgttcctcccttaacggtgatttgtaccataagccgttgccctgctgcttgacaggagagtagcctaaactgtgcagatagtctgcgatgggtatttgtttcacatcttcgatattcataacattttcttttttggggattaaaaaatagttgaaaagtgcgccagtcctgtttagtccgttatatatatacccgtaccatactaaacctgcttattccgatacagggaaatagtaagtccgttcctcttgtatatacacccggactaaaccaaactgacttttaataatggaaatcgggattatagcggtagcccttgccctctttcacaatcatgcgcttgtttacaaggaacttgttaagcgacacaagaacattgcgtccacgctcgtaaccgatactcgcataaccctgtttcaatgccgctatgacattggaatagccttgtaccacctgcttgccgaaaccgctctccaacgcttcccggtgttgctgttcagtcagttccgtaagcggaaagttcctgtcctgcttaggttgttggaatacataatcatccacgatttcgggtaaagcgctgtcattgatacggaatgcgaacgggtcaaattcccggtcacgtatgtgcatcgcctttacctcgcttatgttgccgtcctgctggcttttcgtgatttgcaggacggtttcagccttgttgttcagttccgtaccgatatgcccccttgtgttgtcatctcccttgttcaaatgcagtacggtatggatatgcaggttatatccgcttgaccagcgcatcaagaggttgattaggtcggttgattcgctggggctgttgatgtcgtacatcaagtcacggattccgtcaatgatgagcaaccccacatcgggcatattttcaagcatatagccgataatctgtttccgcttgtcgggggtctgctcccttagcacgatgaaaacaaaatcatccctgtccttgtcgataggtagtccggcaagccgcaaaatacgctccatgaccttgtggcaatggtatttgctctgttcggtatctacatagaggattttccgtttgttcggtggcaggtatgccgaatacttcagtacctcgtcatttttcaacgctgccgcaacgatagcggaaatgttgaatgtctttttgctcttggctttacccgtggatgcgctgaaattacctagcgtgccaatggtagagccgttcacccaaagtatttcgggcggtacttcgtaagtgtccgtcacctttagatgaatagttttccaaagggctgcgaaatcctctttctgcatggtgacgtcctgcccggcttctgtcgtttttctattttccataacctatttctttagaggacggttaaggatatacttctgcgcttcctgctctatctgcgcctgcgtcttgaccggattctgacgtaaccatgcttccaactccgctttctcaaaataaagcattttgccctgcggcttataatggggtatcaagttacccgaagtcagcttgtacaggtaacttttagaaaggttcaagaacttgctcgcttcatcgaagctaagcacgttctttgaaaggaacaacattttttcgagttcggaaactcttaactctaaatctctttccatattgtttaggaatttaggtgaaacaatatgaaggtgcgcaccctcgtttttttgttaacgggggcaaagttaagagcttgaaaatgaagtctaattgacctttgtttgagcgttcaatctatgctcaaccttttttcagttgtttgatgtatttgtctatgatttcatatcctttcggataaatgttttttgcttggtctgtcgcactcgacaggtcagtacgtgtaagcggttctccttttatcttcttcaatatcagtctattgtttgctatgacagactgccattcataaacaatataattatagcaactcaattgcatcataagataggctaacagacgggtattattaactttcaatactccattcagtttgcagttgaaaaaatcggtaagtattttggcactgacggtagtagtaaacatattcgcttcgttcacacattcagtcagaagtttgatttcattggctttcaacgtggacttgaaaggattgcttttgcccacaatcttggttggattagtatctgcactttcctctttctcttttggcaaggattgctcttgaatggtaaccacatctgtatagtaattactttcctgttcttgaagatggcgcaaatacttggaaagcacgacaagattaacgataatggacaaatagggaagccgcccatcataacaggacggttcatgcaaatatgcgtccatatcaaaatcagagcagcggaaaccgatatacttttttctttcatcagaattcaagtcctcaaaataaccgctttcccacaaaaaatcgggaatatccatatccaatacaatgttacgcacgacacagtatttttgttggatggctacaatattttcagtcacacggaaaatttcttgccgcaaataatcctttagctgggcttgcgtcaaatactcacgttttaaaaatagtgcatctactttagttttatagtcatgcgctatacaactatctaatatcttctgtatttctctgaaattggtttctatatgattttccataatcgtgtgcctttaaacgttcttactacaaatataaggtaagaatctcacttttcccgaaaacatcggcaataataaggaagaaaagacaggataagagttaagaaattataaagatacagggagaaaaattataaaagtacaccttttctttgtattcgtcattcagtacacatttagtacgccctataaaagcaaaaaaccctgataatcaggtaattatcagggtttattcgtacccagagccgggatcgaaccggcatggaagtgaatccactggtgtttgagaccagcgcgtctaccaattccgccatctgggcatttttgattaaccttttagctttagcagtaggtttgtttctcaaatgcgttgcaaaggtacagcttttttttaaacccgcaagcgtttgggtaaaaattttcaaatatttttttcacagtgggaatatgtatgggattgtttcgcatagaaagattatttcgttacatttgtaaacgtataatcataataacagccaatatcatgaaagataattattgcgtcatcatgggaggcgggatcggtagccgtttctggcctttcagtagagaaagttacccaaagcaattccttgatttttttggaagcggacggtctttactgcaaatgacatttgatcgcttcgcaaaaatcatccctactgaaaatatatacatcgttaccaacgaatcttatgcggacttaatcaaggagcagttgccggaattagcggaagaacaaatacttttggaaccggctcgtcgcaatacggctccttgtatcgcttatgcggcttatcatattaaggcatgcaatccggaagccaatattgtcgtagccccttccgaccatctgatcttaaaagaggatgttttcttgagggacgttcaaaaggcgttggatttcgtgaagagaaaccgtgcgttggtcactttgggcatcaagcctagccgcccggaaacaggatacggatatatccaaagcagtgatacggtagtagatgatttcaccaaggtgaagacctttactgaaaaaccggacctcgagttggcaaaggtatttatggaaagtggagaattcttctggaattctggcttgttcgtctggaacgtgaatacgatcttggaagcgttctctaaatatctcccggatatcagcagccgtttcgatctaggtaaggataaatttaatacctcggaagaaaaagcgttcatccaagagaatttcccttattgcctaaatatatccatcgactacggtatcatggagaaagcgcacaacgtatatatgctatgtgtagatttcggttgggctgacctcggtagctggggatctttgttcgacctagcgaataaagacgaaaatgagaacgcagtattgaaaaataacgaggcaatgctatacgaatgctccggcaatgtgatcgcattaaataacccgaaacgtctagccgttatccaagggctaaaagattgcatcgtggccgagtctggaaacgtattattgatttgtaagaaggatgacgaacaacgtatcaaacaattcgtagccgacgctaaaatcaaatacggaaaagaatacaactaattaagaattgagaattgagaattatcggcaagcggtattcattctcaattctcaattttcaacttcttagcaagatatcgtacaggataccacgcagctaaaaagcctatcgttaataccgtcacaaagactgttattatatcgaccgggactacacgtaccggataagcctctataataaacgctccggcagcttcccctagttttataaagccaaactcttgttgtagcaagcaaagcacaaccccgatcaagactccgatcaaagctccaaaaccggagatcatccagccttcaaacaagaaaatccgacggatcagactgtcatcagcccccatattacgcagtgtgctcacatcctcctgtttctcgatcatcaacatggataaagaacccaccacgttgaataaggcgatcgccaatataaaagtaaggatcaagaaggtcatccatttctcgacttgcatcatcttgaaagaagcctcttgttgctcaaaacggtcttgcacgatatattgatcacctaggatacgttgaatctctttctttaccggagcgatatccccgctatctttcaccttcaattccaccgctgtcacttctttatcataattaaataaagaacgggccaatgacaaaggcacgatcatatatgaatcatcgtaaacctgttggtccgtacgaaagacagcaccgatataagcatattccaaattgaaagaagaagccggattcgccatgttcaccttctcctcccgcttcggagcgtagatctctagcggagagacaaagcctgcgtttattcctagcgagaaagccaatccgatccccatattcgcataattcgccacctcgtcattcagaaggaactttccatcgatcaagatactatcgatctgcgccagtttctcatattgctcgtctacacctttcaaggtagctacaccctgacgatctcgataacggaccaaggcattgtcctgcaatacctcactaaaacaaacaatgccgggcaattccctcaccttacgtatctcttccgaggtcgggtcgaaaaccttccctttccggggcatgatcttcaactccggatcaaaattgctgaagagagaagataccaaatcgttgaaaccattatagaccgacaaggcgcatactaaggcgatcgtggcgacaacaaccccgcataccgataccatcgatatgatatttatggcattgtgcgacttcttcgaaaagagatatcgccgggctatatagaacggaagattcaaggctcctctgattacttatgcaaaagattgtcgatattctcgatataatccaatgaatcgtctataaagaagctcaattcaggaatcttacgaacctgcaaacgaatacgttgccccaaatcaaaacggatcgctttcgtattgctccgtatagcctccaatagctcttgcgatttatccgacgggaaaatgcttaaataagctctcgccacacttaaatcaggacttacacgaactacgctgacagagaccaatacgccatgcattccttgcgtctgcttctgaaatatatcactcaactccttctgaagaaggcgttcgatcttttgtaatctagtactttccatacgctttattatttactttttccagatcatcgtcaagccgtcacgtaaagggaggatcaccttctctacccgatcgtcttgcttaaccttttcattaaaaaccagtattcccttcgtttgtttatcggaaggatgcacttcttctaccactttaccgtcccaaagcgtattatccgcgagaatcaagccgcccggacggaccatcgggaataccaaatcataatactcggaatacaggcgtttgtcggcatcgataaaaaccatatcgaacgtctcatccaaacgggggataatctccatcgcatccccaaaatggacttttatcttgtccttatgtagcgagcgggaaagatatttcatgataaaatcctccatctcgtcattgatctcgatcgtatggatcaacgccccctcttccatgccttccgccatacacaaagtggcataagacgtataagtcccgatctccaagactcttctcggacgaatcatccggcaaaacatcttcaatatcctaccctgcaaatgcccggatagcatacgcggacggagaaggttcacattggcgtcgcgattcaacgccgacagcaaatccccttcttcatctatatgagaaagaatatacgcatcaatctcgcccgtaaacattcctcttactctttaaaagtaggcaactgatattgcgtgccggcatccagcacctttcctacgttgttaatctccaaaaagctggtaccgccaccttcgccgaagctaccgctcaaatacgctaccatatcgttgcgagtgatacgtccgctatggatcagctggttcaacgcatcatagaaatatcccctacggctgtcgttgtacggctgatgaaccgcccataccccataagaaagacccaacatacgcatcacacgaggattatagcatatagcgaacacagtagaggttccgcggaaagcggccagataacgtgccgtacgacccgtgtaactatccgtgataatcgccttcacatgtaatttagaagaagacttaacagcttgtttcgccaagaaagaagttacgtctaaatcattcccctcgatcggcacacggatatcattcgcggaaagcttggtcttctcggcttcacgagccactttcgtcatggtctgtaccgcctcgatcggatattttccataagccgtctcaccgcttaacatcaaagcatccgtacgataataaatagcgttggcgatatccgtaacctcggcacgagtaggacgaggattattaatcatggaatgaagcatttgcgtagccacgataaccggcttcttcacctccacgcatttacggatcagcatacgctggatacccgggatcttctcggccggaacctcgatacccaagtcaccacgagcgatcataacgccataagccacttccaaaatctcctcgatattgtctacaccctcttgattctcgatcttagcgataatcttgatagggctgttacgctcgtccaagatacgttggatatccaatacgtcctgtttgttgcgaacaaatgagtgagcgataaaatcgagatcatgatcgatcgcccaaaggatattattacggtctttctcagtcaacgaaggcaaattgatacgtacgcccggcacattcacgctcttgcggctacctagcgtagcgtcattctggatctcgcaaagcaaacaatcgccggatttcccggtaaccttcatttccagatcaccatcatcgataaggatgtcgctgccaatcgccaagtcgttcacgaaattcttataggacacacaaatacaatcatgcgaagtttcctgatcgggattaccgattaccttcacgatctctccagtcttgaaagggatcggttccttgtttaccgtcgtagtggtacgtacttccggcccctttgtatccatcaagataccgatacggtcggatacggtacggacgttatttaccacacgggtcaacccctcttccatcatgtgagccgtattcaggcgcaccacattcattcccgctttatataacgcctcaacgaacgcaacgtcgcagcgctggtcggaaactgtagcaacaatcttcgtatgctttaacatataccttaaattattataacctaattattaattctatttgataaccttctaaaccttctatcacataaacgattcgatcgccaaccgatacgaatccagcccaaacccaagaatcactcccctgcatgccgccgatatcatcgacacatgacgaaacgattcacgggcatgcacattcgagatatgcacctccacgactggcgtagtaaccgccttgatagcatcgtgcaacgcaatggaagtatgcgtataagcgccggcgttcaatacgataccgtcatattcaaaacccacctcatgtatcttgttaattatctctccttccacattactttgataataagatatctcacactgaggaaagcgggcacgtaactcgctcaaatagtcctcgaacgaggcatttccgtatactgtcggttctcgcttgcccaacagattcaaattagggccattgatgatctgaatcttcttcattcttattgtaagtttattacctttgtaccgcccgttgaggccggaattatccggcaaaggtaaggattttatttgacacattcataacgacataccgacaatgcgacaaggaaaagatataataaaccgatataacacctatttacggttagaaaaatcgctctcagccaactccatcgacgcctatttgacagatcttgacaaattgctacgtttcgcagaggatgagaaaaaggacgttaaggagatcagctacgacgacttgcaacagttcatcgcccaattacgtgacatcggtatccatccccgatcgcaagcacgcatcatctcgggtatcaaatcgttctatcgtttcttattgcttgacaattatataacaaatgatccgaccgaattgttagagtctcccaagatcggattgaagctgccggaagtattaaccgtcaacgagataaatagcattctcgacacgatagacctcacgcttcccgagggacagcggaaccgtgcgatgctggaggttttatatagttgcggactgcgcgtatcggagcttactggcctgcgttattcggatatatatcccaaggaaggtttcatccgggtagagggtaaaggaagcaaacaacggcttgttcctatctccgaagttgctttgcgggaaattaaaaactatctgtatgaccggaattcggtcgtggttaaaaaaggcttcgaggatattttatttctaagccggcgaggaacggccctctcccgtatcatggtatttcatatcattaagcaacagacagaggccgccggtatccataaaaacgtaagtccccataccttccgtcattctttcgccacccacttgctggaaggcggcgccaacttacgcgctatccaagagatgctggggcatgagaaaatcaccaccaccgagatatatacacatatcgaccgggaattccttcgcaaagagatactggaacatcatccgaggagtaggccaagaacttaaaagaaccgatcatgctccgctagcaaagccccaagaatgtcataaattatttatttcctcctctgacaaaccagtataacgcacgaccatttccatcgaaagcccatcagaccgcatacgccgagctgtttctagacgttcttccgcacggccttcttcccagccttcaaacttagcagtgctcaacacgtcattctggatcataattgcattcagatgttcgtcataagcataacgttcctcgggagacattgagtaatagcgtaatttctctcgtgcctcttccaagccgggggctgtcgtttcggaagttatgatcccgtctttcaagtatcgcacccattcctccaagggggtcacggccaccttatcaaactcattcacccgaaccaatatatactccggaaagatctccgaaggaagacgcttgacgatcgcacccctctccttggtatttacctgtaaatgatcatgggtatgcacgccgacaaattggttctacccgtgatacagataatcggttcctacgcctatatcaaaataaaggatactgatagaatagatctttttcaccccggaatagtcctgccccaaatgaagatgctcggtgacggccttcgccacgctatagagcacacgttccaaataataaagctcgcgggtattctggatctcgataaggatgatatctccctttgtgttcttagccttgatatccacccgattgaatttatcatcagcgtcctgctggttcccctcactctccaatatctcctcaatcttgatctgctcgcccaagaacacggtaagaaagccttctagcactccgaaattcgctttttgccggagtaggcgtttgatggcccagtcgaaacggatatatcgatcttgtaattccttcatatacttctcctctttttctgttttcttttccatagtcatatcatgttttagttaccccactattgggtggcttcaaatgtacataaaaagatccggaatacaagcttatcccatctaaaaagaaatgtccttccttttggatccgtaagtgaatagccaacgaacggaatcgtaagcggtcgcaaaagggtattcttgtgccgttataactctattttaacctcatattgtatcggtttaaactatttacccaaaaacaaaaaacatggatgtggacaaatataaagactactcaattcttagaaatgaggattctgcaccaaatggccatccgatgctctgtcgcaccaccttccgaatgctgatcgccgggagaggcgctattggtgaaatcaatccacgctttatgatcatcttccgcccataagttcaaggccgttccctttacctttttactatcataccgttccatagaggttcccagtaaaacggcgaaattatgtttatcgatcgaacgtttataactcaacgtattctcccaaagaagcttcacgccacgattcatcgtttgctccaccctcgatttctcagtcttgaccatataacacaaatagctaacagggaaccaatttctttcgccccaaaaagccatatccgtggagagagggctcttaaacgtaagactctcaaatacttctaattcaccccaaacagaacccacaaacttaatccctctacgggaacgctctatcaattcccggatattattcatctccggaagacgaattaaattaggttcaaaaatctgacgcttgaaaatgcggtagatactccacatagaaatgaatgtgactatctatcgggaatggcagttcttgaaataatggtttcataggctttatactaaaggtttcaacctctcgatcagttcatccccaagcgcccgtttattcacgatatgttcctgcacggcggtaacaaacggattattcatgaaatctcctcgaacaccctcgaaatcctgttgtttttctttgctggaaccatccacaccgaaaccaatcatagaagtcaaggagaattccttacgggcatcctcataaagcatctcatccaagcggatcacacattcttgccaacgacgaaccagatcaataatctctgcggcggaaatcgaacggagatccaccccataataacgttcgatcatctcgtacgcccatgtccattccaaggaataataacgtccgtgaaccaaacggaaaaagcattccacatcctctaaggaagcgatttccccctgttcgatatcttgcaacaaggcttctagcggttccctcgggaggatcaagcccgccaagtccaaccattctccggagcctttggattccgtagggcgcaattgctcccagacctcttccatagaacaataggtcgtaccttccaaacgcttgattaacgagttaccaaagaacttattaattgccatcccataaaagttcaacgcattccggagggaggaaccttttatacgagtattctgataataataaatctcggaagtctctccaaccaatgcctgcaggtttttcaagatatccaccgctttcagcatcttctggatcgtatagggactcaatagattatagttaatcatatccaagcgatccgggtccgtacgtttatcacgtttcggccatttctgggcatcacggatcgtacctacgctgcgaagattaattcccggaactaagtaagtctcatcatccttctctattaaataggagaatggaatatcggaagtatcgctatgatgatgatggcggcccattaccaaagagaaagcgccaatacgagccggccaaagaatatacgagtcgctggtagtcttggagccacgttccacgatcccttgatggatcggtcccagcttatacatatgattactctggttagagccacttcccgcgttcaagaacgaatacattcccgctatcaacaaactactcttatgcatagacaccgtaaacggaccggcgaatatagcgcaagcctccccattctcgaaagcgcagttgctgaacaacaaggaatcatgggccgagaagttatgcgtcacttggcaagcctgtccgataaagcaacggataatcttagcggcatccgcgatcttggctcccgaagagacaatgaaatcttgcgcgatcacactatccccgataaataccggggcctctctcttactatttacggaaccattttccagacgtgcgctattctctatggtcgcgtaatcaccaatcttcacgttacggatcgtaccggtattgacaatcttgaccttatcgccaaccgttccctccgtagaggcgataccctccgtataagcggtaatcatatcccgcaagcgttcgatcaaggccggacgatgacggtacaatgcgataatataagccaatgaagccgacaggccatcgtaaatcggaacctcacgcccgccggtctcattcaagaccgacacctcgacattattcccgaacgtagccttgccttccaccaacataacatttatattctggataaagcagtcatcaccgatctggtaattagcgatataattctgtacgttctcgatcagcacattatcccccaacgtacaattatgtagggtaacatgacgaagcccgctatgctttaccaatcctcccggtagggtaaacgctttacgaaaggctcctaacttaaccactcccgaaaaacgcacgtggttcacatattcaatatcaaacacctctggaacccaaacttgattccaatcatcggcccggcaagcctgagatcgcaaggtggcgatctcatccggccgcaaatttctcaaatgattcattggtactaattttgtaagactctactcttcatcatattgctgaaagaggaagtcattgtaggggaaacgggtgatatggatttgtttaacccgttcatacaacatctctttcaacgcctctatattcgtacgttccttggcggagataaagatgcaattatcttgcaattttcccatccacgtacgtttcagttcatccagatcgatattctcacgaccacgaggggtcaaatcatcttcctctttcgggacaaaggtaaatgcatccaccttattgaaaaccatgatcatcggtttctcggtcttatcgatctccgccaacgtacggttcacgacctctatttgctcttcaaaagtcgggtgtgagatatccacgatatgtaccagcaaatccgcctcccgtacctcatccaaggtagatttaaaagattccaccagctcggtcggtaacttgcggataaatccgaccgtatcggacagcaagaacggcaagttctcgataatgaccttgcgtacggtcgtatccaacgtagcgaacaacttattctcggcaaagacctcactcttgctcaataagttcatcaaggtagatttacctacgttcgtatatccgaccaacgctacacgtaccatcttaccccggtttttccgttgtacgcttttttgcttgtcaatatccaccagctctttcttcaatcgtgcgatcttatccaagataatacgtttatcagtctccaactgtgtctcacccggaccacgcatacctacgccgcctcgctgacgctccaagtgcgtccacagacgagtcaagcggggtaacatatatttatattgtgcaagctccacctgtgtcttcgcatgggcggtctgtgcacggctagcgaagatatccaagatcaagctcgtacgatccaagattttcacctgcaattctttctcaatattacggagttgcttcggactcagctcatcatcaaagatcaccaagccgatctcattctctaccacatactccttaatttcctgcaatttaccggtcccgacaaaagtgacggaattcgggtaatccattttctgggtaaaacgctttaccgcatccacccctgccgtatcggccaagaaagccaattcgtccagatattccttaaccttttgctcattttgctcgggggtaaccaaacccaccaaaacggccttttcggtctgtgcctcagatatgataaattctttcatgccacaaagatatattatttcaattatttacgtatatttgcgaacatatttacaaatataaatcaacttagctatgaaaaagagaatttggcatctatccagatgcgttgtcgtttgtacggcattcctattcgtacaacaatttatccagtcacaagtttcaaatccatctacatgggaaagttttgtgcaaagtaacgcaaatatatctatccgggatacgtttcggatgcagacatttgagggacttgcttctgataattgggattatgccattacaggtgaagcccttattgaagatatctccggcgtgaaagatattcctaacagccacggaaactacgggttacgaatgccaatgaatacgcaagtggctttcgagcatttcacgttaacaaatcatcaagatataaaaatcagtatacggaaagggggcatccttctagtagaaggagaaggcatgagagccagaacctatcgaaaaggggaaacaagttatccctccttagttccaaccataggagagagtggcatcaatcctttcaaaaccacagatataaaaaacaatcctccgggcttagatcttatcgtccccacaccggccgccaataccaaaaacggctattattatgtagacagcgtttacgcacacggcatgattcctacctattccctatttaccggaaacagcgattggaaccatgaggatcactggagccatctacccacctaccgtcaccgcaacgccttgattaacggtaatatctccataaatacaaatatcagctgtaaagatatctttattggcaatggaaatatccatattttaccaaccggaaatctatccgcaaataaccttactatctatccaaatgatggtaccttggcgtcttcctccaccttgcgatcgtccggaactattaacatctccggcaaaataacgatcgagaggaccttcgctcaaaaaggcaaatggtattttatctccttccccttcgatgtattcgcttccggcatagacccggatttccaactgggtgatgacaaaagcgatacaaacggtaactacttttacgtacaaacctataacggagaaaagcgagccaactcacaaagcccttccaacaactgggaagtcataccacaaacaataatcaatacatcccagcccatcttcaagaagaacaaggggtacctgatcgctattgacgcttccgccgatcgtcagaaccttcgtttctcctcgaaagcaaaagatatccctatagatttcggaaaaaacggtcaagcctctattccggtaagcattaacaaccaaagccagaaccagaatcacaacggctggtatctatgcggtaatcctctgccggctcctttatctcttagtcaaatagaatcaaactcagccttagacggatacatttatatatatgacggctccacctaccaaccctacgtgatcggtagcgatttcgccatccctccattctccgctttctttgtcaaagcgaataaaagtaccagcctatctgtatataatacatccgaaccagccaattataaattattatcaacgaatgcacccatatctttcccaacatcggaacctcaagcccgacaagatcctcctgtttccaatcaagccttttcatttccggaattaagctatcagctagagaacaaaactttattcattaataatcttccatcccccggtaaagtcaaactacttactccggcaggcatattggtatttacgcaagcggtacaggcagggaaccctatcctcccgattcccctcccacaaggtttatatatcttaattattcaaacagaacattatcgggcacagtacaaatgcgttttaacctcctaaagcccgaaacaatcttatatctttgccctgttttaagaataaaacgaatatgaagaagatcaacatcacaacaattgccttacttgtctacttaatcgtaatgagtatcatcggctggccgggaaacaattcggggaataattataccgaatatttcttgatgatcggcgctacgctcgtcatcatcatccttctacgctatctgcaagtcaaacgtctgagaatgcgagataagtggaataaagacgaagatcctgccaagcaataaaaacacagcctgtttttcttcacagaagaacaggctgaatgaactttattttattacactagtattaatattactgctttttcgccctcacaggctacttgaatgtctcgtaaagactacgcacagtataaattattcgattataaataagtacaatcttaacaggacacacacaccacttgtttcgcttactttcttaaaatgagttactttcataattcttacattttattcactagtactaaaacgtcattaaccaatacgcaaaagacaaccgacatcatttttgtaatcgtagcctaatcgtcatatcactgaaaggcaatacaatcgtgaacacatttttaataacatagacatatcatcgtaatataatcacacgtcctttgcgttctgaaaaaatagattaattctaatatattttaaggacaaaaggatggacaacagaaattactttacgatggcgattcccgctcttttgctaggcgtagcatacttacagccaatcaatgcggcaccagcggaggatctgccaaacgttactggacgaatgacgatcacccaacagacattcacggtaagtggcgtagtcaccgatacgaacggagaaccaattatcggggctaacgtgattgagaaagggactacaaatggagccgtaaccgattttgacggcaaattttctctctcgctgcaaaacaagcaaagcatattggtcgttacttatatcggttataacaccaaggagattccagccgggaatggttctcccctcacgatccaattgcaggatgacacccagaacctagacgaggttatcgtggtaggttatagtgtacagaagaaaaaagaccttaccggtgctgtttccgtactggaggtaggcgacctgaaagataccccggtatccagtgtagatcaaatgatgcaaggtaaattgtccggcgtaaacgtaatcccggataatatgcccggcggaggcgtagcggtacgtgtacgcggtttcagcacgatccgtaacaatgatccgctttatatcatcgatggcgtaccagtagagggcggcatcaattttctcaacccgaatgatatcgaaagtatgcaggtattgaaagatgcttcttccgcttccatctatggcgcacgtgcggcaaacggcgtggttatcatcagtacaaaaaaagggaaggaaggtactttccgggtaaacctagacgcttacgtgggagtacaaacctcggcaaaacagatgcgtatgctaaacgcccaagaatatggcgacttattatggcaggcacagcgtaacgacgggaaatcaccagtaagcgacgtgtatggctccggcgagaccgccgtaattccggaattccttgacgcagatcaccgtcttccctcgggagacgtggattgggttgacgagatcatgcaaaaagccatggtccagtcctataacctctctctggcgaaagcagataaagttagcagccacttgttctccctaggctatttcaaccaagacggtcttatgaaatatactggtttcgaacgtatatccggacgtttcaacaatgagtccaagctcttcaacgatcgtttgaaaatcggtgagaacgccacattatcacatgcgtggggaacctcggtcaccaataacgccgcactgggaggtatgttatacaacgcctataagaccgtatccattacccctgtttacgatctggacgggaatttcggcagcaacccgatcgccgacatctccaacccgttaggcgaattataccgtaataaggataataaagatcgtaccacccgtctattcggtaatctattcgccgaactgaatatcctagagggactttatttcaagaccaacttcggagcggattataaaaacctgtataaacgaagcttcaaggccaaatacaacgaattgaacacccagcaacccttgagtacgttgagcacgcaaaaccgttggaacttcaattgggtattcacgaacacgttaaactatttacggacattcgataaacatacgatcggagccttattaggtatcgagacaaaccgttatcaagaggaatacttctccgcctcccgtgaaggctttgcctcggatgacgataacttccatttcctcgatgcgggcgatagtggctcccagaagaacgcaggttctgcctttacttccaagatgatgtcttatttcggtaaaattgattataatttcgacaaccgctacttattcgcagccacgttccgacgtgacggatcttctaaacttggtaacaataaatggggtaatttcccggctgtctccgcaggctggcgtatcagtagcgaaccgttttatgatattccggctatcagcaacatgaaagtccgcataggttggggacaaaacggcaactctgatatcccggcttattccacgatcgattcttacatgagtaatccgaaccactccaactatccgatcgacggtagccaaagttccgtgacaaccggatacacccaaacccgttacggtaacgcaaacttgaaatgggagaccaccacgcaaactaatgtcgggctggatctaggcttcctagataacagcctaaccgttgtgctggattggtttaacaaagataccaaggacttattatgggagcgtcccttgatcggtaccgtggggggtacaaaccaaacggtatgggacaatgtcgggaaaatgcgtaaccggggtttcgaagctgaggtcagctacaataagagcatcaataaagatttcgggttcaatgtcgccttcaatatgtccgctatcaagaacaagatgacggaattagacggtgatgtctcctatatcggactgcctaccagtgtgattcactccctcaacttcgatcaagaggtttctcgttccgccatcggtcaaccaatcggctctttctacgcttataaagaagacggtttattccagagcgaggcggagatcaaatcatataccaataataaaggcgaactactccaacctaacgcaaaaccgggtgatatcaagttcgtagacgtaaacggagatggcgtaatagacggtaacgaccgtgactatatcggtaacccgctccccgatgtcacagcaggccttacattaggagtcaacttccataattttgacctcagtctattctttcagggaatgttcggaaacgatgtatacgacttgacccgttatgtgggtgatttctacaatcaatcgcaatacaacaaaaacagccgtgtcgttaatgcatggacaccaaccaacacgaatacggacataccccgtgtcaccatggacgatccgaacaataacatccggccctcgtcttactatgtgcaagacgcttctttcgttcgcttaaagaacatgaaaatcggttattccgtacctcagtccatcctatccaagattaagttcaatagcttgtatatctatgcgcaagcaaccaacttattcacgatcacaggatacgacggtatcgatccggaagtgggattgcaaagttactccagtgactaccgtaacctagatatgggtgtggaccgcggcatctatccgttatcccgcaccttcacctttggagtaaacgtaagtttttaatcatcaaacaacaacaaactagaatatgaagaaaatgattatagcggcctgtgccgtattcgcattgacatcatgcagcgattttctggaagagacacctgtaggcgaactgactcccgaacaagcacaagatcccaataacatcgagggattgattatctccgcctattccatcctagacggccagatggacgatgccagctccggcttgaattcaggatgctccaactggcaatttggcgatgtgatctcagacgatacctacaaaggcggaggtggtacgggagaccaaaacccggttcacttaatggaaatcttccatatcgacccgactatccaagattacaatcggaaatggctagccttatacgagggcgtgaaccgttgtaaccaagcgatccgtatcctcaaaggcagcgattatgataaaaaggagacccgtatcgccgagatgcgtttcctgcgtgcccatttctatttcaacttaaagatcatctataaccagatcccatatttcgacgagagtgtcagcgatccttccgcattcgcctctatctcgaataaggagtatacatccgatcaattatgggagaagatactgaatgattttaaggccgcctacgaaggtctcccggattcccagccggatgtggcacgtccatgtaagatgacggcccgggcttatatggctaaagtttacttgttccaaggcaaatggcaggaatgcgctacagcgacggatgaggtgatcaattccggcaaataccagctactccccgacttccggaatatcttcttgccagaaaatgacaactgctctgaaattttattttcagtccaagcctctatcaacgatggctccccgaacaactacaacggaaatccgggcgaccgtttgttacctccgggaggcccttatcccaactatggtttccttcgtccttcccaaaacctagtaaacgcttataagaccgactccaacggcttgcctttggaagacggcatagacgtttcggaaaatgattatgtagacacccgcctagaccacacggtagcccgccccggaatcatgttccttgatgtccaactctatgactggactcctcgtgaggctacggtttacggtccgtatagcccgaaaaaacgtattgtctccaagaactcaagttactatttggctatctggccatacgtaaacgcattgaatgtttatattattcgatatgcggacgtgttattgtggcgtgccgaagctgctatcgaactaggcgatttggctaccggattgaaatacatcaaccaagttcgcgagcgtgccatgaacagccagaccgtaaaaaccgctgacgggacagcggatgccgccaaataccggatcggattatatccgtcattttccgacaaagaggaggcgatccgagccttacgtaccgaacgacgtctggaattcgccttagaaggtgaacgtttctttgatctagtccgttggggaatcgcctcagacgtgatgaacacttatttcgagcatgagaagacattccgctctcatctccaaaatgcccgtttcatcaaagggacccacgaatacggcccgataccgcaagcggttatagaccttgcgaaaaatggaatcatcgagcaaaacccaggatattaatggaaatgctcccattcctcttaaaagaaatagctcctatccgaatattcgggcaggagctatttacatttgtctttttatatcgtctccttataacttatcccttaaaaaccttccggtataggatgcctcgcaagccgctatctcctccggtgtaccggcacaaaccaactgcccgccggcctttccgccttccggtcctaaatcgatcacataatccgcacatttgatcacatccatattatgctcgataattaccacggagtgacctttctcgatcaaggcattgaaagctttcaacaaagtcttgatatcatgaaaatgtaaaccggtcgtaggctcgtcgaaaacgaacaaggtaggttgctgcttctcttggcctaagtaataagccagtttcacacgttggttctcaccaccggataaagtggaggaagtctgtcccagcttgatatagcccaaacctacgtcttgcagcggtttcaagcgtttcacgatcttcttctcttgggagccggaacctttctcgaagaactcgatcgcttgattcacggtcatttccaacacatcgtatatgttagcgccttgatactctacatccaatacatcctgcttgaagcgtttgccgtggcaagcctcgcattccaaggtgatatccgccataaactgcatctctaccgtgatcttgccctcgcccttacattcctcacagcgacctccttctttattaaaggagaaataggcggcgttatatcccatctgtttcgctaggggctgctcgccgaatagtttacggatctcatcgtaagcgccgatatacgtcacagggttcgagcgagaactctttccgatcgagttctggtctacaaactcgatcgcctgaatcatattcaaatcaccactgataccggagcaatccacggtcaggcgggcggcatcatccaaatgacgtttcacgccctcgtagaagatatcacgaaccaaggagcttttacccgaaccgctcacaccggtaaccaccgtcatcacgttcaaaggaaacttcacgtccacaccctttaagttattcttccgagcccctgtcacttctatataattattccacggacgccgataaggcgggatctcgatctgatcctctcccgtcaaataacgtaccgtatggctatcggtacatttccggaggttattcacatcgccttgataaacgacctcgccccccaaacgccctgctttcggaccgatatcgatgatataatccgccgcacggataatctcctcatcatgctccaccacgaccacggtattccccaaggcttgcaactgtcgcaataccttgatcaacaaatccgtatcccgggaatgcagaccgatactcggctcatccaaaatatacaacgaacccaccaagctactacccaacgaggtagccaaattgatacgttggctctctcctccggataaagaggccgagaggcgatctaaagccagataacccaaccccacatccaacaggaattgcaagcgattattgatttccgtgagcaaacgtttagcgatcgccgcatccgtctcgtccagttccagttgatcaaagaaagcctttgcctccgaaaccggcatcgtcaccagctcggcgatattcttaccacccacttgcacatacagcgcttccggcctcaagcggctccccttacaaaccgggcaagtcgtctttccccgatagcgggcttgcatcaccctgtattgtatcttataaagattctcttccacgaacttaaaaaaatcgtcgatgccgtgtaaacctctcgccccatgccacaacaaatctttctctttctgtgtcaagtcgtaatacggacggtggatcggaaagttatatttctcgctcttcacgataaagtctttcagccattcccccatcacctcacctttccagcaaaccacggctccttggtagacagacaagcttttatcgggcaccaccagattctcatcgatgcccagcaccttaccgaatccctcacaggtcggacatgcgcccaacggattattaaagctaaacatcatatcggtaggctcctcgaatatcatgccatccgcctcgaacttcttcgagaattccttcacgactaccccttcctccgtataaatacgaatcaaacaggtaccatggccctcaaagaaagcggtctcggccgaatccgccaaacggcttttcaaggtcttatcgtccgataccgtcaggcggtccaccaacaactcgatcgggtaagacagcaactcctcgctcgccagtacctccgagatacgatataccgtatcatttaccgacagacgggcatatccttctttccgcaagatctccagctgctccttcatatcccggccttccggcaagacaaccggagcgaatacggcaaaacgagttccttcgggatatcgcatgacctccttgataatatcgctcacctgatgttttttcacctcggtgccggaaaccggcgatatcgtcttcccgacgcgagcatataacaagcgtaaatactcataaatctcggtagatgtaccgaccgtggaacgcggattacgggtattcaccttctgctcgatagcgatagcgggcggtattcccttaatatagtcgcattccggcttactcatcctccccaagaactggcgggcgtaagcggataaactctctacataccggcgctgtccctccgcataaagggtatcgaacgccaacgatgattttccactccccgacagcccggttatcaccaccagcttgtccctcggaatctctacatctatatttttcaagttgttgacacgtgcccccttgatgaaaatcgaattgctctcagacatattacctttatctttttctttaacgcaaagatagccaaaactaactgattctgccctatcttcatcgaactaattcacacagttagacaaggtgtgcctcgtctctactgccaagtaaataaaataacaagggcgaaatatttcatatttacagggaatcttctacatttgttgaaaatttcatagacaaacacagcaaggcacccatgtacattaaatattttcgcttcttagtagcgattctcttttgtgcgataacctcatgttctacggttcgcgagaagcctcgtccggctacgagtacgggcaaggaggccaagcgagagtttaggggagcatggatacagaccgcttttcaaggcgaatacaaggatatgactcccgcccggatgaaaaaagacttcatccgcaagcttaattacctgcaagcatgcggcatcaacgccatcatctttcaggtgcgccccgaggcggacgctttctataaatccgatatcgagccgtggagccgcttcttcaccggagagcaaggcgtagccccggcaggtgagttcgacccgatggccttcctgatccaagaatgccataaacggaacatggagtttcacgcttggttgaatccttaccgggcgagcacggcgggaaacacccgtttcgccgattcccacatctatcataagcatcccgaatggtttgtcacctataataaacaaatccttttcgacccgggattgccggaaagccgtcagtttatctgccgggtagtgcgtgatatcgtcggccgttacgacgtggacgctatccatatggacgattatttctatccctatcccgcagcgggtatgcctttcccggatgataacagcttccggaaatacggcttgcgaaaaggatacagcgaggcgcaaaggaacgattggcgccgggagaacgtgaataccctgatccgggaattgaaacgtaccatcctgctcaccaagccttgggtacgcttcggtatcagtcccttcggcatctaccgcaacaagaaaagcaccgcagacggatcgggtagcaataccaacggtctgcaaaactacgacgacctctacgccgatatcacctattgggtacagcaaggttggatcgattataacatcccccagatctattgggagatcggacacccggcagcagattacatcacgcttatcaaatggtgggacaaaaacgccaacggaggtcatttatatatcgggcaagacgtggcccgcaccatgaaagcggaccaattaacccgcaagatgcgttacgagcgtgccttgcctcacgtgagcggcaattgtttctggcccgccaatgagattctatggaacaacaagggcgtagccgacagcctgaaacggaactaccaccgttacccggcccttatcccggcctatacccatatgcataaccgtccgccaaaagacgtaagcaagctaaagaccgaatggacacctaaaggcttcttgttacattggcaagcggagcaaagccccacgaatccggagctagcctcctatttcgtggtctatcgctttaacgacaaggagccgatagacacgagcgatccctcgaagatcgtggctatcacccgggaaaccggctacttgatgccttacgagaaaggtaaggtaaaatatcgctatgtagtgaccgccgtagatcgctttcacaacgagagcgagggcaagacaaagaaagtaaaattataaagacaccaattatgttaaccgaccatcgctgcaccaaatataccgactgttcctcttgtagtttctaccagagggacatattcaagtatcgtctttatccgaaagggtacgtgatccctcagacaagatgcatgcagaacatggtctttttcctagtcaagggagagatctggctgaacagcgaggagcacccggacaccacgttccggggcggacagttcgtattgcaaccgatcggctcgaaagtggagtgcaaggtactcgactacaccgaatgtatcatctatctcttcgagcgtccgcaaaacatatgcgacaatcgtttcaacaaaggcatctccatcgtggagaacgaacgccagcagcccatcgtaatgacgatggtcccgccgatacaactcttcatcgagggcatgaagctttacctcaacgatgatttaagatgctccggactgatgcaagccaaacgctcggagatggtctacttgccgaactgctactaccccatcaaggagctagccgccttttacgccccgatttaccggtatagccacagtttccagtatttcgtgatgcagaactaccagaaggcgaaagacgtggagaccttcgcccaattgggaggctacagcgtacccaccttccgccgtatcttcaaggatacgtttggagagcccgcttatcaatggatgctgaaacgcaaatgccaagacattcataacgaccttatcatgacagagctttccatatccgagatttgctacaagtatggctttgaatcgctttctaacttctcgcacttctgcagggctaatttcggccaatctccccgctctgtccgttctctaaaggatgaaaatacataatattcaatgattttttttaaatctctcaacttttgcaactctttggacaaaaataacaattctcccctttagcattccctatacatttgcgtccagaagatcaatcataattgattttcaaagataaataaaatgtataggtacaataagacaagtattatcttaaagatctctatcgcagttttattcattatcggcatggtgctggaatgtagttgcgagagatccgaggaaccggagaaaagaggcacgggctacatcacttgcacccttcgttgggatagcgtggtagcaggttccccggtaccggagaaacttcgctattgtatctacccgtcggagggcgggccgatgatacagacggatgggaacgccaatggcatcaccctgttcttaccaccggataaatataatgtattggttttcaattacgacgcgaaaaacataggttttcgtaatatgtcgaagttcgaggaagcggaagcatatatctcctctctagaggatctggaggcatgtcaagacgaggtgatcccgttatatgtcgccacgatccgttcggtagaggttgagggggacacggagaagcataaggaattgaccttgtcgccgtttttcctatcgaaggacagttccttgaatctaagcaatgaaaggaaagggatcgcaaacaatatcaacgggctaaagaaaacgagtatccgatgagagagagccggttatttatcatcttgatctcgcttgtcatgggattggcgggatgctcgaaagagactatgatcggcgagtatgtagaccgttgcgcggtgcgcctcgacatagattggggtccttgcggtatcgacccggatggtatgaccgcgctcttttacccggtcgatggaggggagccaagccgtttccttaccaacacggtgacgggcgacgaggtgcgattgaggaaagggatctataacgtagtggtatttaaccaagcggccgaagaatacagttatctcacgatcgaaggtcaagatcaatacagcaccctgcggatcgtgatgaagacgacggatagcgattggtacacgcccaccgagggagagcggctgatctacgatccggaacctttagcggtagctacattggagggttttgaggtgacgcaagagatggtacgggcgaaccttaaggagggaaaggagttttccttggcttgccggcccgagaaggtaatcttcacgacccatctgtccttagagataaaaggattgcacaacatgcggactgcgaggggatcgattaaagggatggcggatacatattggatagcggatagaaagaccggaagtagcgtagcgacgcaactcgtggacttctcggaaaagacctttcacgagaactcaacgaccgatggtatcttatccggctcttacttgacactcggcagaccaaacgtcacatcgaaggccacggacgagatcagtaatttgcttacgctctccatcttattggtcgataacagaacggtcattacgaagcaatatgatatagctccacgtgccgcgatcaataatgagacgaaagaggtagaggtggtgctgggtacgaaaattgatctggataaggaagaagttcccgaggatattccgttggagctaccaaacgtggagccggaaaagaatggcggcgaagggggattcgatgcgacagtagacaattggggagatgagacgaatatcgtaatccccgcataactatagaatgataaatagtaacaacataaaacaacattaaaagactaaacattatgaagacaaatttatttatcgcagcattaagcctagtagtattggcgggctgctcaggcgaagatgagattggcacattggtagcaaagaatgacaatgcgattaatttcggaacttatgtggggaaacagacgaaggccagtattatggatgacaccaaactacaaacaacgggattcaatgttatagcaacttatacaggtgtcgatacatgggcatcattaagtggagacaaagctaaagctccaaacttcatgtacgatcaagccgttacatatactgatagtaaatggtcttattctcctatacaatattggccaaatgaacaaaatgaggatggagatcttggtaaagtaactttctttgcctacagccctaaaacaactagtatcactacaatatcagacaaagcaaaaacaggagcaccgactattaaactgactgtttccgatgaaattgatacgcaaatagatttagtagcagatatggtcacagatcttactaaaacaagcacaactatagatggagttgcagtagatgcaggtactgttaaattcaaaatggatcaccttctttctcaaattaagtttcaagcaaagctcaaggcacagtacactggagcaacaaagattaccgtaacaggatttaagttatcatttgcaaccaacaaaattaagaatgcaggaacatatacatttaacactaataacacagataatatatgggtgctggataatacttaccacaacgtagccatcgaaaaaacgaacttagcaaatgagttggacaataccgtagcactagcagcgaccgacttactagatcctatgtttttacttcctcaatcatatgcagaaaaagatataacagctgtgatcagttacactgtaaccacaagtgcaggtgatgttaataatgtaaagaaaatcgatttaccggtagttacagacggatggaagcctagtaaaaaatatttatatacttttgagatcgaattacagaatgtaacagttggagtagaatccgcagaatggggtaatggtgaaatcaagtaatatattatctttattttcatagattaagggattaggcttcctcaacatagaagacctaatcccttaattaatttttaatagccggtcttcatatcaccgcctctcttctctatcataaaatccattctcataaaaacacgccactctatatttagctaggattacttacaataaaataaatatcagaaaacctttcgatagcaatacggtcattatcccacctttttgagcaatataagccatatatcgtgacatccccttctcgcaagaaccacaaaacaatgagaaggagatagccattagtgccctttttctcctcgaaagccccccttttcacacacaataggtcgcgaaagccaacgcgaaaggccgcgttaggcgacacatatggttacgttgggcatcgtaagcagctaagaatagggttataacctaatgagaaaggcgttataaccttattataaccctatcgtaaccttatggaatagcccaaacacccggcaaaccatgagttacgatgaattaatttcgctagaataaaaggccattttccgacatctgtctgtctactaaacaattgctgtttttttcttgcgtatttggaagcgagacgtacatccgcccgaaataatcgactctcacggatttccgtttacattttgtcaaaatgtcaatccgcgaggaaacttctccccacatagcatacggatatcaattattcttcctatatttgcgataatccctcatatctaagcgtaggtcactgaaggaggacataagttaacgaagagcgtttaaagatattatcccgtattgaaatctggacaatttcatatccatggataatagacaataaacgctcacgtcggtgctatatttaccagtaattgctctggacgatataacagcatggcgtgggctattgtttattacatggatagggccgtccagagcctcaatacggtaatatcaatagtttccacgcttctgtatttttagcccggcaaccgatggagacaggttgcccttatccattaaatgaagacgatcctcctgttacccgtcttgtcgctatggctcctgcttgccacgcaagccaatgcccaagtctatcacctacatttatccgacaacacttgccggataacagaatgcgttgatactccacaaggcgtcaagcccttgggtcagacatggaaaggaaacaccttccatgatcgtttcacgctagatttcgatcgcgctatcttcacgtgggaaaaggaaggaaaagagacgtatgccaacaagatcatcaaccacactgccaaatacgctcaccactcattcaccacggagcagattaccgccaacctcaccatcaacagccatcgagccgtccttcaacttatccactttcagaatggccaatggatacaagtcacttatttttgcgagatagggaattaacggctcatgcgaacatctacaacatctaccacttatacttgatatttgtactttttatttgtgagtgaaaattccagccttaaaaaaggaggccttaaagtttacgataaacatcttcaaaaggtactctgcaacgttccccccaaatgcctttatttccatcccgtatcccacaaggaatagccatgtttatttcagcaccatgaggtagtttcaatgtcctttttagccgacggctgtccagcccttctaaggggcacgtgtcatagccttcgtttgccatcgcaatcataaacgtttgtgcggcaagcgcacaggatttatgggctgtcacacgtatgtcattctcggaaacttcaagcatcataggacggaaaatactgattatattagccaacaatttcctaagcaatccgagaataccgaagaaccgggcataaacaaagggcatcaatataccgtaatatatttcccgatccttaatacgtttggcctgacgttctttaggactgtaatgacgaatgttctcccgttcaaaattgagtacgaatcgcgcatgtttcttgtaccagtcacgccgaaccacaaaaatgacaatttgtgaagcggtagaagccgctttctgaccaaggcagtcccttgaaatttttgccaataattcaggttctgtaatatggtaaaattcccataattgcatatcagaactgttaggagccaatgtagccagttccaaacaatgttttaccttttccgtatctattggtttttctttatcatacacccgtacagaacgacgatgatgaaggacttcatctaaattcataatgatactgatttgaattaaacatttattcccagctgattacttcagccatttattatcgtgctttatttaattgccgcataacgaccttcgccatttctttagaactgaacgggtcctgcccagtaatcagattattatctacaactacttttgaagtcataggtatcaatgctttttcataatccgctcctctctctttcaacaacgcttcaagatcaaaaggcacgtcttcttttcttctggcaagactttcctcaaaccaactgaatcccgtcagctttttgcctttaatcatatattcgccattggatagtttggcattcaacaacccactgaccccgtggcagatggccgacactatcctcccactttcatcctgtttccttacgatagtctttaaagcttcattgccaggaaagtcatacatcgcaccgtgtccgccggctaaatagacacaatcaaactgttgttccaacaggttatccaaactgtttgcatgatccaacagctttttgaattctggcttttcccaatacttttcggacatttcatctaaaaaaattggttttaaactttcgggatcaatgggagtataacctcctttcggattggctaccgttatgtcatagccgctttcttttgcactatgatagatatgagtaaactcactaagccataatccggttgcgagtttcccattggcaaaagtccctgtgctagtaactattattaaaatcttcatgataatcaaattattgattcatattctttaaaagaaaacatacacatggatagattgtttttcagaatatggaatctttaacataatccgaaaatatgaaaacctgcaaatcctttcaaatgctatctctatccaccagcattcgataaggagaaattaccgatccctttcctattacctccgggaggaagcaatttgatgaatattgtttccatgatgcccaagttgaaagaagaattaagaactattttcaacgactatggcttgaaatatgtcttcgataccaatagccaggagattaaagtaatgaaagaaaagaaaccgggagagatatttttaattccatttcattccatagccgataccctgcagcgtatgattttctacaaagcggctattgaaagtaacagtgagtccgcattagtttttgaagaaccggaagcccactcataccctcctttcatatcaaaggtaacgcaggatattatccaatcggacagaaaccagttttttataacgacacacagtccttatgtggttaacgactttctggaattaccgagtgacgaacttgccatttacctagttgacttcaggaatggggaaactttcgtgaaaagagccagtgacacagaagtacaagaaatgtacgaatatggcatcgagctatttttcaacaccgaaacatagcgaaagatacagaacacattgcaggcacaagcccatacccaagtctaccgcctacgcttattcgacagtacttgcaggataacggaatgcgttaaaaactattttacggaatgtccaaatgttctgtcaatacgtttacgaatgttcgtaatggcgcaccttcataattatccaactccccaaccaagatcaacgcggcgttcttcatccatggctggtatgggatagatagttcataggggatttcacggatcagttccggggtgttcttgattaccgtataagcgtcgccatcggcggctttcttgccttcgaaaactaaggtacggtcgaacattttttgcttgtttaccccgtttagtactaccggggccatgactacggaatctctgtcgctactcaacatcggcatcaaggacagggtttgatatcgtcccacggagagtccgcagacactgatcgttaggtctagacgcaaggagttgccctcccgctcgatgcggttttgcttcacggagacttgcccccggtaagattgtataggcacctgcgctcctgccggaagaacaaggccgatcacaagcaagcatatatacaagcatatataaatgaatgtcttcatagatttatctctttatttgatgatgtaaacgatactgatacctgcctttgttaatccccaatactcgttgcggaacttgccgataggcgcatctcctctaggaaaagcgtacttatcatattcgaaatgcaagtatccgaaacccgccgtgaactccacgttccaacggggcgacacgtataactgataaccataagagataccgccgccataagcgttaccgttataactattctttttctccatcccatacaggagcttcaaaccagcgaaatcgtaatccatatactgggcatgaaccccgaagaaatgtccgttgaaacgctcgtgtatccagtaacgcgcctcgggctgtatcatccaatgcttaaatgacttatcgctcgagaatgtccaaccgttataataccccgatgcctcaacggaccaatgcttgttgaaagcgacctccgcccctatgttcggcgtagtgatcgcgtcataaagcacattggtcttcacggccacgacctgtccttgaatatctataaaagttggcaaaagaaatactaacagtaaatatagtttattcatatctcccggttcattaggtttgtttatttaagagacaaaaccgtacaaatatagataatatttatcagttcattcgtacgttaacttatataatatccacgatttacaaacggaaaacgttatctttgcaagataaatccagaatatgactcatgaaggctaaatatatcgtgatttttctcctgtcactcctttcgtttgtcgcttgcgataaagaggaggtcgttatccctactaccgcccctcgtacggttcttatctatttcgcaggagataatagcttgagtggatacgtgagccaaaacctgagggcgataaagaaagggattgagcgagatggattgaacaacggcaatttattgatctatacggataagcagaacgaggctccccagcttttccaattaaaagtggaagcggataccatccggcagatcgtgctcgagacctacgactcgaaccagaactcggcctctaccgagacgctgacgcaaataatcgacaaggtacaaaaggaatatccggcggatagttacgggttggtgctgtggagtcacggaacgggatggctaccttcggatatctatagctatctgcgttctttcgggcaagacgggaagaataatttcatggagatcaatgatttggcctccgctttatcgaagtatcattttgattttattttgttcgacgcttgttatatgtcgtgcgccgaggtagcttacgctttccggggatgtgcggattatattatcggctcgcccacggagatactggccaatggtttcccctatcaaacgatcatgggggatatgttcaaaaaagaagctgatgtggtggggatagcgacaaagttttatacgtattatcaaagtgaggcaggaacgatctcggtcatgaaaagcgatgagttggatgaattggccgctacttgccgtaccctattccatgataagacggaaagtgatcttttcgccgtacccgttagcgaattgcagatcatggagtatttgacgccgaattatcatgccttatatgattttgatgattacgtgagccgtctggccacggaagagcaatataacgcattcaagcggagcatggaaaaggcggttatttacaaggctactacacccaaggcagtttacgcttatccgtatccgtatggaagctatctgccggtcaataaatatagcggcttatctatctacgtcccccaagaagccttgcccaaactgaacgagtggtacaaggatcttgagtggtataaagcggtctattaatcaccccttatccaacgctttccgcgaggagtgtgaagaaatagtaagatactccctgctattgcagcaacaattgtaaaaaacacagccactactatcatactaatctattttaagtattaaacttccaatatatgcgaaccatacggtagcaactaagccaactccaaaaatataccaaatgatcaaaggtatagtatcaacatatgataacctttccctattacctatattaaagaaagctccacctaatcccaacactaaagccgcaaatgtcaactttgacaggtcaaagaaatactttgcgatattctccttccgtatcttcactaactctcgcgcctctttattcttttctctccttctttcaaaatcactcatgacaaaaatagtatttatatttcacatcccattctatttcactaggaaaacttctttataacgttcaatttttccttgaggatgaacaagttccgcatagaaaatataaacgcctgttctcaccttggaaccattcaccgcaaggccgttccaagtcaattcaccttctatccctaataagtcatgatttaccacctcactgatacaccttccggagatatcaaatatccaagctctacaggtatagccggattcatctagatggtaagagatggtatattctttcgtcgcttcaaagtaaacgggaggctctatgcccgttacctcgccttcatcttgctttccatattgggaattccgatagccgggcgtaccgtatcccgccgtggccgaagccgaggtccaattcatctcatcctgcgtatcgctatcaggattaatccgctccaaggcaatccccttctcgtttttcacggatggggcatgccatttagaggaataacgaatctcatcgatcataacctcatcttctgtacgaaacaggactaacgtagcggaggtatttgccaagaccggaagttttaattcatgcaaagcatccggcgaagatatcagataaaaatcgctcactcctcccatacttttagtcagcaacgcataatcttgtggttctaccggagagactatagaagataaaggataatgcgaactcaatgtaccatcggatttacgagtagcaacagacagtccggccaaaggcaatgtccggtccgaacgattataaagctcgatatactcactcccttccgggtaaggattcggcaacaactcattaaaaacgatctcattgggtaagactataatgtccgtggggatacccggtttatggggagcgtccggacgatctggatcttctggttcatcgtcaggagaagagttcgcggaacccggcgtgcctcctcgctcatccgttgataaatgaaagccggtttcagaacgttcccaagcgataccggctttcgctttctcataggcaatccggtcgatctccttaccggaaggatcgaataaagcaagctccttccccgtgtttaccaacgacgccgggaatttatccaagggcagatccagccccgcatcatcaatatgtatatccctaccggaccgataaagcacgacatatccatccgcatccaaaaacaaagctgtcaataccgttggcttactaccatataagaatgaccaaccatttaactctatagccttatccgtcgtattataaagttccacatactccgtttccggaaaagccttttgtcctttcggatcagccatcacctcattaatacggatactaccagcggggaaagaaggagtatccggcacttccggttcctccggaacgtcgggctcttcttcatattctaaccgaatctcggtagaactctccggaatcttatttccctcaagatccattaaccccgagcacaacaaatcataacccatgccaaccttcaactctttatcaaagctgatattcacatagatccgcatatcatccgcataggtcatacgagaagcattaccgatacccgatatagagaatatcgcctcacggatatccaccggaagattatattgtaattggaaaacagactcggtgatcggttggatagcaagaagccgcggaagaaccaacggctcatcgggctcattgggttcttctggctcttcgggagtatccggcttctctggttcgatcgagatattatcggatataatgatgtagttacacgcaaaatcatttactcgagttttagaatagcggcattcaaaacgtagttgtccccctttacatgaagaagaaacttcagactcacaactccctatcaagacaaacctacccttctctagcacatataagttccatatcttatgattttctaaagtaagtttcactttcaaatccacggctcccaacaagacatcgagcgctttctctattaagatctttggattcttctccgttgcggtatgtttccgaaaagttatcgttttcttattactgccgatttggacataataatcgttttttaatccaagcatcctctgatcatctaaataaacatgtagccggatatggttttgatcgcttggtttgaaatccatccgaatctcaaattcccattccattgtagcggaataaacgagaggagtttctatggaaacacttttccgggtaggatccgcacgtgagaccagccatccggtctcaatcacaaagcaatctaaatcacccgtccaagggttatccgatgtaatctccagtccattaaacggttcttttaactggggataagcgcaaagcggaagtaaaaacgcaagaattaataataattgtttcatagctatatcgttttagttataaatttctctatctttgcaccctaataagttacaactgtaaataatagggcgcaaaaggcaaaaatatgaaagccctttacagacagcaaagttataactattttacattattcaaattaaatcagtgctcaaaatgaaagtagcaattgttggtgtaagtggagccgtgggacaggagttcctgcgtgtactcgaccagagaaacttcccgatagatgagctggaactttttggctcatctcgtagtgccggacgtgtttataccttccgtggtaaacagtataccgttaaggaactgaagcataacgacgactttaagggaatcgatgttgcttttgtttcagccggaggtggtacttccaaggaatttgagaagacgatcacgaaacatggtacggtgatgatcgataactccagcgcgttccgtatggacgaggatgttccattggtcgtaccggaagtaaacccggaggatgccttgaatcgtcctcgtggcgtgatcgctaacccgaattgtaccacgattcagatggttgtagcgttgaaggcgatcgagaacttatctcatatcaagcgtgttcacgtatctacttatcaagctgccagtggagcgggcgctaccgctatggctgagttggtaaaacaatatgagcaactattaaagggcgaggagcctacagtagagaaatttgcttatcaattggcatataacgtaatccctcacgtagacgtattcacggaaaatggctatacgaaagaggagatgaagatgtataacgagacccgtaagatcatgcactcggatatcgaggtgagcgctacctgtgttcgcgtaccggttatgcgtgcgcatagcgaatctacttgggtagagacagagcgtccgatcagcgtggaagaggctcgcaaggctttcgccgaggctgagggtgtggtattgcaggatgaaccggcaaacaaggattatccgatgccgttgttcgtagcggatcacgatccggtttacgtaggccgtatccgtaaggatatcagcaacccgaatggtttgacattctggaccgtgagcgaccagatcaagaaaggcgccgctttgaacgccgtacaaatcgccgagtacttgctaaaggtgggtaatatcaaataacagacaactttgtaaattctatatacgtggaagcgggatcaagagaatactcttatcccgcttttttatgcttagcgtaattcctccatgccttctcaaaacgtataaatcaatacgcccaatacccgatggttggttatcgaatgtgtgtcatgaatccgtccgccatcttgcaaatccacattgccataccatgcgatggaagggctatattcaacacctaatttccagtgcggaagattatacgaaagttgcaggttggtcgtaaatacctgatctacgtccagacctacgccataggttttgcctaccagtgcctcattcgctcccaagttcttcaaatagcctaagaacaaacccggtttccatttctttccgtacacgatattcaaccaagaagtagagaagagatacggcgaatattcctgttcgccggtacgtgggtcgatagaggtgacgccgtaaccacccaacatacaagtctgcgtcaagttagaagccagcaaggttttcgccatcaccaaccaattcgcgtcctgatatttcacgtgcgcctcgccggatacggaagaaacccgctcgctgactttataaatcttgccatccacctcgttctgcgttctcggcactaacgacaagatttccataccggctcctacctgccaaccgggtttcttataatccaccccgagatagacttccggcacgcaactattcttgatatattcctcgctctttccgttcggtccagccgatagatattgcaactgccatagaaccgacccggtcaattgccacccattgtccgtataacgataacgaatttgcgggctgcggttaaagggctggaacggggcgccggtagaaagattcaacatctgtggaaagacctcgccaaatagcggatgccatgtctgtccgatcaagacagcggacttgccccaatccagattcacataggcatgacggatacggagcaccgcccaattgctacccgaaccccggaaatcggcctccagtttcaaggaagtcttggccgaaccaaccttcggtccttgtacatcgattcccaaacgggagtaaagcaggtaaaaactaccgttcggactagcgttcaagtccttgccatccgcatccaacgccacgtccttcggatataggtggaacaaaccatccacgatctcggcattcgcacgggaattatagaacaagtctccacgtacctgtccgtaaaatttgtaagagaagtttttcttttgcgcctgtacgcataccgccatacataggccgatcaaaagaagcaagttgcgtttcatttccattccggtcaatctatctttaaaaataatacatcatcaaacctaatatacgatgattcgttatcgcatgtgtttgctcgatacgtccgctctctaagtcggtcgtgccataataagctgtcgccggacaatactcgaaaccgaacttccaatgcggtaaattatacgatacgtttaagctgacggttattaattgatcgatatccaatcccataccatacaccttatccgctgagaccaaggacttcccggttcccaaattcttcgtatatccgacgaaaactcccggtctccatttcgttccgtaggcgaaattcacccatgtcgtagaatggcgaaaaggcgtatatccctgctcgcccgtacgggagtccaccgagctcaccccgtaaccgcccaataaagcggtatgatccaaggctgaggccatcaaggttttcgccgcaaaggtatagtttcttccgctatacttcaaatgtgcctcgtaagagaatgcggtcattcgctcgttcaccttaaaagtttgctccttccattccgtggaagtacggggtttcaaggagatcatatgagcgccgagccccatcaaccaaccatccgcaggggtaaaatccgcccccacgaacatctccggaatgcagctattcttaatataatcctcgctcatgcctttcggtccgctggaaaggtattgtaattgccacaacacggaagccatcaattgtacccggctattcgccttatactggtaacggatctgagggctacggttgaaaggctggaacggcgctccggtggaaagattcaagacatccggcatcacggcgccaaacaagggatgccacgtgatccctactaataccgccgattttccccaatccaagtttacgtatgcctgccggatacgtaacatcgtattactaccggaaaaaccgccaaagtccgtctctatcttagcggaggaacgagccttgccaatgtcgggacccgtcacgtccaagcccaagcgggaagtgaacgtatagaaactgccattcggcgtggcgttcaaatccttgccatccgcatcaaaactcttatccaaaggatagagataaaagttcccatcgatcggagccatattagcccgggaattgtagaaaagatctccacggacgaagccgtagaatttgtaagtgaagttttttctttgcgctgtcgtagaaaataaggctagcatccccacgagcaacagggtaatctgtctcattataattcagtttgttatttttcttaccttataagccgcgaatgtatatatttttatggattcaatttgaagaaacgaaatattatttgttcctttgcttccaagttgtaagccttaaaggtcaaattagattaatattgtaaacaccagataaagaaaatgagtactaaaaagtttttgctagaagaaaaagatatacctacggcatggtataatatcgtagcggatatgaagaacaaaccgctgccgatcttaaatccacaaactaaacagcccttaaaggaggaagatttatatcctctattctcgaaaggtgtctctcatcaagaaatgaacacgacagacacatggatcgagatccccgatgaagtacgcgagctttataaggtatggcgaccgactccgttggttcgtgccactggattggaaaaagcgctggatacgcccgctcatatctatttcaagaacgagagtgtaagcccgatcggttcacataagttgaattcggccttggctcaggcttattattgtaaacaagagggtacgacaaatatcacgaccgagacaggcgccggacaatggggtgccgctctttcttatgcggcaaaagctttcggcttggaacttgccgtttatatggtaaaggttagttaccaccagaagccctaccgtcgttcgatcatgcagactttcggagcacaagttgttgcctccccgagtatgagtacgaaagccggacgtaagatcttgacagaccatcctaattatcaaggtagtctaggtaccgccatctccgaggcggtagagctggccatgcagacaccgaactgtaaatatacattaggtagcgtattaaaccacgttatgctgcatcagaccgttatcggactggaagctgagaaacaaatggaaatggctggcgagtaccccgatgtcgttatcggttgtttcggtggtggttccaacttctccggtatcacattcccattcctgcgccataaactaacggaaggtaaggatatccgggttatagcggcggaaccggcatcttgcccgaaacttacaagagggcaattccaatatgacttcggagatgaggcaggctataccccattaatcccgatgttcacgttgggacataatttctctccagcgaatatccatgcgggaggtttgcgttatcatggcgccggctccatcgtcagccagttgatgaaagacgaattgatgagcgccgtggatatcaagcaattggataccttcaaggccgctaccttattcgcacaagcggaaggaatcataccggccccggaatcatcccacgctatcgccgcagctatccatgaggcagagcaagccaagatcgaaggtaaacctcgtacgatcttgttcaacttatcggggcacggcttgatcgatatggccgcctacgaccaatatctatccggtgatctaacaaactatgaggtaacggatgaggaagtagctaacaatttgaaagatttggagaaaatcatctgataaaaacaagaaaaggggcgataccaaatcgcccctttcccctatttgtctatgaaagtcttaatttaaagtatgtattatgagaaaatttcttcgtaattagtactcgggataatcatgttctggacatttaagctaaagtttttctttttcttatcccacataccgtaatttgtctttatctctccactttgatcatcatattgataagtgatctgatagaatggaacccattcatcgtttgtccgatcccaacgaaacgctttcttctcggaaaccttgccgttctcgttgtactggaactcatatcttacctgtttgttcaacagtccgttttcctgtaagaataccactttagagataatcttaccattctcctcttttgtatcatatagataatctttaggagacgctgcgcttatcgctaaactacacatgaaagtaaaaacaagcgcaagaatacttttaccccaaactgatgtcttcatactattttaatttataaggttactatcattttgtaccgcgaagtaaggaagtttcccgacaatcaccaaaagcaaagtgacaaatcgttagtaatatcacaatatttaacacattcaagaccttcattcccttcgattctcccatgtttactgacatattgtaaaccaaatcgtaagttcccccgatttttaaatatctattatttaccaccagccggatgtaactttcaaaagaaaactttagacaccgcttttttaataaattaaaaatctattgattaataaatatattcttacttttgcaaaggcagaatgcaaattgatttcttgacatgcgacaaataatgaaactatttatcacatcctttctttttatcctattctcaggatgtacaaaggatgtatatgatccttccaataaaattccgggagaaggtactaatccattctcaaaggtaacaatttcctctaatttcgattggtcgatgatacaaatatcccaccttaccgtacaatctttcgacccctatgatggcacctataattatctggtagaagtatttgataaaagtccggaagatcaagatgcgaatcttctcgctaccggggtttgctcaaagaaaacgcttttcgataagaaaattatctatccaaagggagagtcggatcaagtttacatacaattgacgacccctaccggatatcaagttaccgctcctgtcaccttaacaccgggtaatgataatgtctgtgctttcgattcgttagccgtatcgcaggaaacaaccgctactccggttagccgtaccccgacccgaagcgtgtcttccacctatacatttataatagaagactctttccctaattacggagattatgattttaatgatgccgtgataaaagtccagatggaaacttccatgaaagacgattatgtacaattcgccaatataaaactgactttccgtgcattaggtggaactaagcgggccggagctttcatccatctccccggcataaagtccaaagacatccaaaaagccgagttaaatggctggaccacgactccagaatcggaaaccgagactccggtttatgccctatcggatgatatacatggattattctcttttcatgaaatgattaatacagataatgaccttccatataggggaaagcaagaacgtttgatcaccttttcgttcgcagccggtgccttaaaagatttgaccattgatgacatcgatcttttcacgaccgtattaaagcgggaaggagaggtcttacgcacggaaatccaccaacgtaattatagctatacccccaaaggggtcagataccgttattactcaaatgataattgcatatgggccttaatgataccggatgatttcaaataccctgtggaacatgcttttattggtgatgcctatccggatctattgaaatgggtaagtggagatagcaaacatgtacaatggtataaaagtaagaatacggttgataagtggatttatacccgagaacaataacaacctaaaatcctccgtaaaatgaaaacgaccgccatcttatatcttgcctatctggctttatgcgttcagtgctcagtgccggaaaacaagagcacgaaaaaagagattaatactcaaccgataaaggtgggtgtattcgatgggcatggaggagcacagacctgtatttgggaaactgtcgccgctatccggctggacccggaaatggaggtacgtaccattactacagcagatatagctaataatgtgctcgattcgatcgacgctattattatcccgggaggaagtggcaaaagtcagtacttaaacctagggaccttaaatcaacaacgtatcaaggacttcatcgctaaaggtaaaggggctgtcgggatctgtgccggagcctatctattctcgaatactcccgattacacctgtatacagctaaatggacagcaagcgatcgacatcgagcatgacaaccgagggcatggattagcgaaattcaccttatgcgaggagggtaagaagatattccccgaattagccgaccgcgatacgagtttcgtcatttactatgagggaccggtatttataaacaatccggctgatacgatccaaagcaacacgcttgccatcatggaaagcgatgtgcatgaggaaggaaacgccccggctaatatgacaaacggtaagccattcttcgtagccaataactacgggaaagggcgtgtttttagttccatcgcccaccccgaaggtactcccggcatgatgtggatgatcccccggatggtacgttggaccttgaataagccttttatcccttatcaatcctccgccgtacgtccagacctgttcaatcatgaatcattaatggctaccgatgatttaaagcaggaagaaaaagcctttcaaatccttttaagcggagaaagcgagcaaaaagttgccgccttggattggctggaagcacaccattcatgggacgccaaacgatgggtacaaggattgctttatgacgcttcacccgccgtccgtatccgggcagcccggtatatagcggatacccattacttaccattcttacccaacttacaggcggcctaccggacagaaaccgataaggcaacccaagaagagttaaagacgcagctggagaaactaacagccttacttccttaggctagggagatttaaactctccctagatattcatctaccgtatagtttaagaaacgattgaatggtaataacaatttaaagtcatccaccgccttatccatccaattcttagcgtaaaagaaattatccggcttataagacaccacgctgaaatccttatgcttcatgatataaccataaggggaatccattggatagccggcaggcatgcgtttcagcatctccccctctaacaccgggaatgttttcttaaatgtaggttcctcgataatagccgtaaattcctcgatatgatcgtatatatcctgacgaagtttctttaatagcgcaggtggcgggcaccatacaccaccggaaagcaagcaacctcccggctccagatggatataataaccaccccgttcgctggcacgaccaccttgggagatgtaagcggcgaaatgacatttataaggagtcttatctggagagaaacggatatccctgtatatccggaacaaacaatctttcgcctccaacccggctacctcgggatcgaataaggagatacgaccgattaaatcctgtacctcatcaataaaaaccttacgtagcgcatcgtaacgacttttattgtcttggaaccattcccgattgttatggctcctcaactctgtcaagaactctatgatctgttcattcataactttctatttttaatccttacaaatgtaagaaatattagaaactgtaacccagattcagataaaattgcaggttattattccggttcgacaatccgaagttcgtattcatcggaccgactatactgttataagcataaccgatgctacctccccaaacgctttctcccttgaagagatcgaagaaattattctcatggatcgcataattagcgatcaaagagatataatgccgttgcccgatacgctgacgcaagtttaagcggacaatcgccacggaattatcgaatatctccatatggttgatcccggcgaaagggagttgctggggaagataccgttccggcatatcgcctcccaccacattcaaaaagggataagccggatctttcccgatcaacacacgcccatcgatggaaggcaacaggctcaaatgggaagtcagcggcaataccgacaggaagctgagcttcaaggcggagaagaatgtatgtcctttataggtcacgaagttatccgtataaatggaataatccgcttgcagagaaacgcctttactcgggaagtaacgacgatccaacgtctccagatgggcttgagcgaaatagctgataaagccttccggttttacttgatacttttggttttccgccgtataaaggaatgagttataatcgaaatactcataacgggctcctagcttcaacttgaaattcagccagttcatatccgaatacccgagttccacgaaatgatggcgatacgtcgtatttacgatcttatttcccctgttatacacgtcgaggtcatggtacgtgaacatgtaagacaggttaatattacgcaatggattacgctctatcgcatagtccacccgcccatacatacgtttcccgatcctcccggttacggagaacttcgaatggtaacgggcccgattgtcaaaagtcacattcagcaatagggcgacgatatcctcgctattgaaattcaggcccacattaatcgcgctatttgatttttcctgtaccgtaagcaccaaatcctcctgcctctcgccgactaatttatagcttacattcgagtaaaggtttgtaccgatcacgatagacatggcttcctgcaatttcttcacggtaagcaagctattctctttcaagccgctgatttgcgtcaaccatttctcatcacgaggatctataccttcaaacaagacacgccggatatgaaacgtatcggtaggggctaccggataggaatgtactaatctctttcggtgcatatccgaactatcggataaaccaatcttcttctttaaggcaagaatctcatcccattgcttgcgggcgacttgctcaccccggtcaatcaaggtatccaaggccgtctccccaaaactagcggaattataagggtctgtattcgggcggaacaacagatcggtctgttccttattcggtccgtatttctcataaccatgcaaggcgacgatctgccctacgatatcccaaggggtatttatccgctccaactgtttcaagtcgctagtacctagatctacgccaataatgatatccgcccccatatcccgtgcgacatccgccggatagttattcttgatcccaccatctaccaacaccatgctatccaaacgtaccggcgcaaacacggcaggaatcgccatactggcacgcatagccaacggaagacttccatgatggaaaacatattcttggccgtccaccacattcaacgccacacaagcgaaaggtatattcaattgattgaagtccacggaatcatgatagccgatcgttagattcgagaacaggttctggagattttgcccttttatcatcccttggatcgctatctcttttttactccgcccaaaagggagtgagaatacataacgctcggaattctctttctccggaaaagtaaggctactacgtttcacccggtcgctcaataacatactccagtcctgcaatctcaccatgctatcgatttccgcagcattatatccaacggaatataagccccccacgatagctcccatactagtgccggcaatataatcaatcgggatgccggcctcctccaataccttcaacaccccgatatgagcgacacctttcgccccaccgcctcccagcaccaagccaacctttttccgctcagccatcacagaaggcaccaacatcaacccaaccaaccacaataaaaggaacttcctcatctagatattctttccggcaaatgtagctggtttactcgaaaacgcaaacggattcatctagaataaaacgtatgtttacctatatataaagtttatcgctatctcatctattctataaaccatgccgtgaactgtataaaccaaggcgtggtctgcacattccacggcgtggtttatacagttcacggcgctgatttaagaataaatacttattcgctatggaatgtataggttatcggagaactatttcaacaagagaggaacattttatttccggaacataagtgggcaatcgatagtatttgatacggcctccctaaaattaataggcatttctcgctaaaatcgatttacgtattatgaatcaagtatgtacgtgtttatcaaaaaataatatagccatcaacttacttttttccagcaaggtagcagccggagcaatatattactttttctttttcagcagcatgaccacaggattcgactcttcatccaagtttgcggcgatctccttcaactttccttttagctggcctttctcgtaagcctcaactaagtccggggcatctagagtttggcagatagctatttcggggtttcttggctctgatgttagagagacttcttccttattgatgaaatcatcattgtatagaatatagctgaataaggcattttcttgtttatcatacaccagatcttcaccaaggaaacctttaaacgtcgtaaagtcaacctcttttctcatggttctcataaaacagtagcgatcggtgataacggttggaaaaagaaagactttcgtatccatggaggatatggaagggcttcttacgataaaaggactcagattaccatccggcaagtaatggaatatggtatcagacgatgtattgacaagtatccatttatcccgatccgggaacgtaagataaaattccggcgtaatgacaaactccccttctgtcacaaccggagtctcaatacccttagagggaatctggatctcatgggtgatacggccatcttgtttggaaataatcaaatggcactcccgcttgcctttttccgatggataactcttatagcaaatcaaatgatcacgatcataattaaatatataattataataactggtatccgtgaacttaaaactccttttatagtttcccaataagtcatagacacctatttttctcgccggattatccttgacgaatatctcatcgttatcctcatccaagacaagccctgtaagctgcgtgtattcctcaccgctttgccctaaacggtttatcttcctaagtccctttccgtttttatcgaaaacaagaatatccccatcactgccccgattcgtcaccagcatgatatcctttccgatcgctttcacggcacctttagttataaaatcatccgtggtttccaacgcaatgtattccacgtccataagatcttgaagtatcaattccttttccggataatcggccatgacatcaacccttataaggttatcgacagaggaagcggaccgattgccacatcccatacatccgactaaagcgagtagcatagccactgcgttcgtagttaattttctcattttttatgatgtttaaagtctttcgttcgatgtcatttcttgctctttagcattttctcccgatccatcattcgtatcatctcttttacctcatcggatgtctccggcagttgattgatcaggttacgcaaatccacgatagaaatcttgctctttttcccatccgggtctatcatagtctcctccgccacattacggaaaaacatatcttcatagaaggattgcagaagcgcccggctaaacaccatcgtcctctcgtccgcttttttctttaagctctcattcatataaagtaccaagataaaaagccctcgctggcgatcctcctcactctggaatttagacacgtcaatctcactatacatatgcgagatcgccgccaggaaatccagtcgttccggattcttcttccatgcctcatagtagagacgggacgcttccttatatctcccgtctttttggtaagtctccgcacggaaggccaataattgatttaccaagaaacgattgggctccaatcccttttccgcccggtcaaataagtcgtaagcccgcttccggtcatatgtcttacccaaggcggaacccaataagaggcatacctcgaccgaggtcgtatcctgctcataagccatatccagaatatctaccgagggcatatacagaccggcataatacttcgaggctcccccatatttcaaggtaaggtaagtagaatcaccatcagccaacaaactggaatagacagaatccgcctgaacaaattgtttcacggtatatagccccaatcctttactacgcaataattgacgattcccgggattataaaacaaggcggtatcgcaaatcgctattccttccgatatataatccgggctactagcccccatccgatacaatgaattcactaacgcaaccgccaaccccgcattctcacgattcaagttatacgcctgaaaataagcggtcgtagcggaaggatattgttccattcgagtatagcaatcgccaatcgcacggtataagacagtattatcctcattctgagcttgcaatttctcataggcatcaactgctttctcatactcccccaattggaaatacagacgtgccaactgataattagcgtagaagttcgagctatcggcggataagacctgatgaaaatatcgctcggcatcctccgcacggcctaagttcgtcgccgtccgagccaagatgtttaagatatccaagttcgtcgtatccatagaaaagcaaagacggtaatagtcataagccttctgataccgaagcataccctcataagcctgcccgatagcgttcataatctcataattcgaagaatcggctaatgtaaggctatcagcatgagcgatcacagccgcatattgcttacggttcaccaagtcttgccaattaaactcttgagcattcccgggaaaaataaggcaacaaagtaacagaactgtaactaaattacatttctcattcatatctgtatgtttttaagattactgattaagcgaccaacacagcctctattcttatttcactgtaaccggaaagtaataggcaccgtatataagacgcggaccgcctttccgtcctgacgaccgggagtccaccggggcatcattccgatgactcgcaaagcttccgcatccaaggagggatctatcccccgtatgattttaggttccacgatatttcctttcttatctaccacaaacgaacagatcacacgaccttgcactcccgcttcctgcgcatctgtcggatactttatgctttgagcgataaacttcaataattcacgatcccctccgggatattgcggcatcacgtccactaccgtcaaagtctcttccttcgcttcttctaccggacttttcaaacggaacgtaatcgggaccgtatatttcacggcgaccgcctttccacgttgcattcccggattccaacgaggcatagtgtttattacccttacggcctcctcattcaataaaggagtcactccccgaagcacctccggattattgacggaaccatcacgcccaacgataaacgagcagattacacgcccttgctccccgttatcctgactctctttcggatactttatattcgtggctatgtatttcaacaactccgcatccccacccggaaaactaggcatcttctctaccacggtaaatacttgctcgttcatctcacgggatttggaagataaggacaaatgggtattatttgtcatatcagcagccaagacctcttgagactcccttccttgatagctgcatcgcaaaatcgcattcgcagggacctccaaagagaaagcccctttcttatccgtgatagtcctctctttaccgcccttcaccacaactgatgccccgatcaaaggctgcccggtctcatcaaccagaatgcccgtagccgtcaccatagcgttcgagaccgtagcctcattcgccagacggacagtcaaacgggctaccgcctcgatattacttaacagcatcaagatccctaccaatggaataaatatcagatatttcgtacgtacgatacccgggctccgcttcttgttcatcatcataatccggttcttcagatgcagcacattgaaactattatacaaagtagtaacggactgatgatgagccaatcccaataaatggtattgatagctcttactatcgtaaccagactggatcaccgtgttatccgccagatactccagattatgcctaacctcacgcttcaataaccatacaaaaggattaaaccagcaagccatacacatcatctcgctcaagatcacgtcaatcgagtgccattgggatacgtgcgtacattcatgtgtcaatatctcatccgtttccttatccgaatgactctccggatgcaagaagaccatacggaaaaaggagaatggcccggcggccttccgcaacgcataaaccggagtttcatgaataacaacacgctcactggtatgagccaaccataagatactgcttaattgcacgagaaaacgtccgcataagaacgctacgatcccccaataaataaaccccaaagatcccagcaaccatccatgccaatccacggacgccgcggcatccgctttcgccgtcgcctcaggcaacatagcggaatacatataaatcacatctgctataggctcttgttgccttacccaatcttggatgttcagcaaaggataaaacagagccaagccaaagaacgccagcaatatcgcacgacgtagcttgaagaacgtgtccttatagaagaacaaccggtagaaggcgtaaaagagtacaaaggctacatttaccttcaataagtaggcaaattccggtgtcatggtatgtgggatttaggttattcttttcctttctcaatcaaatcgatgatatcctttagatcatccgtagagattttctgatctttcgcaaagaaagaaaccatttctttatacgagttagcgaaataattcgttaccacgccgccaaggaacgtacgtttatattccgtttcctctatcaaaggacggtattcatacgtatttccataacgtttcgccttcacgtacttctttcgctccagattcttgatcacggaagcgagcgtcgtataaggaggtttcgggtcctcgtatttggccagcacatctttcacaaaacaaggaccgatccgccaaatccagcgcatcgcctcttcttcctgcatcgttagcttctccataaatcttatccttttattaatgtatatccacaaagctacgaaatagtcgtaaacggcatgcggaaggcacgttaattaacattaaataagaatcacaagacctgcaatcgtgaattattgcaacttaaatgtgatcggcaccgtatatttcacggctaccggctcgcctctttgcgtgcccggtgtccaacgaggcatcatttgcaaaactcgaaccgcctcttggtctaatgccggggagattcctctaatgaccttgtaattcgtaagtgttccatccttcgttaccacaaacgaacaaatcacacggccttgctctcctttgttttggctttcttgtggatactttacattcttggctataaatttcaaaagctccgcatcaccgccgggaaacttcggcatcacctctactaccctaaatacctgctctccattttccagcgtatcttcgtcctccgcttccacctgtacttgctcttgtttttctgcctttgttacatctgtcggaacactttcttctttttgttccgaagactgtccgcatcctacgcacatcgccaaagcgaacaggatgatcattgtgttcataatcgcctttttcattttcaatcagttttaatgttatttataccgttattacacatacttaccaacctctaagcatatccggatattacgtcggtttcgcaaacatacgaaatactcgtaatataaatataaacaatatgttaaataacactaatagccatcaaagacatagaaaagataaaagaacatagcttctatcgctagattattacaagaagtacaaccgagcgatacatatcgaagtcaaataagcgaatagaacacaaaaaccggattgccctcctctccttttaagtccaactcctgcggaatcgtgatcgagtgaagcgacttatataagtttagctcatacggggtcactacttgtaccaactcatcttttatgaccctcccccagaccgggaaattccgataacttctcgtaccctgcatgccatgttgaaggttcgcgtccgccagttcatagatagaccccggcatctcgcatttttccacgagtgtctttcccgtctttttatccacagaggcgatataatagccttggttatacaataaacggaaataataatgtgccggaaactcaatcatatcttgcacaaagatatccttggggtcctttttttcaattcgcaaattactcatgtccgtaacatccaacgaacgaatcacttccgcatccgagtttttcagatcaaggacacaagccgcacttattcgatccgccgagatacagaagaccgtatcattactaccggtcttaaacaacacggagttttgcgcatcagaataagcggaggcgatacttgtcgtgaacccgctcttctcatggggtaataaaaaggaataaaaatcattcttgatcgctatcgtatcccctttcctcgaaaataggcccaatccgaatccccctccgttgaaaggctgaaaagggaatgatatggcggcgaaacgatcctttccgatatgacgcatatagattaccgaatactcatgggtggattgtccgataaattcaccttctaatgtatattcccaaactcgattattactaaataaaaaaaggcgatcattacgttcgtccacttggatacatggcagaataccgctaaattcacccggtccctgcccttcttttaccaacgtccggataaaacgcccttgccgatcgaacaggacgatacggggctcttttacgggaagcacatagatatatcgatctgtcacggcataatcataaactccgtctatcaacgaggcatcatccgtggtcacctctaaagggacaaaagtaacccccttgatctcatcgcctaattccaatagccccggtttatccatcccccctcttatatccgcggttaaaagagaggacgcttccgttggcgaagaaccgcatgacacgaaacaagaaacgacaaaaacactatttaaataaaacaagatagaggctaactttacacttttcataaccatgcttttttgcctccaaaaatatcccgtatatctcacaaatcacataataaatgagaacaaaaatgagaacaaacctgccaagaccgctataaatatataataatcaaaagtttgatataaactccacaaatgcctccgtagaaccttctttcttaaaaatcttccggaatagacgaggacgaagtaccgaactattatatttcaatacccgtgtgatctggttggcgggaacaccgattttcgtgagcatacaggccttcaactccgtatcggaaataacaggatatagctttttcagccgtaaggtaaagtcatcataagccttattcaacaaaacctccaaaagctcccaatcctcagagataatcttgccggcatcccgatcgtgaaacttctcatagacctccgatttccgcaagatcgcgacagataataaatgcttactctccttattaagaatcgactcgttacaaatttccagccgttgtttttccaattgtaaggaaaccaacatcaactcttgatccttttcttcctttattttcgtaattcttttttccaaaagggtgatttgccgttcattctcttctttttcttctcgcatacgttgttgctggctagcaatcgaacgtcgcaaggcttcttcccttcgaagagcgttttcctgcgtatttctccatcgccgataaaggaggaagcaaataaataggattatgccgataataaatgcgtacagataacgctcctgtcccctttgtaatagcatcaactctttcttagacaagtcctcacggatcggccttacatcatagcgggaagtgatctgataaatcgattctctcgctgatagtgatccgatagaatcccgtaacatctcgtatttcttgacctcggtcagtatccggtcttgtccggccgcatcgttcaataactgatattgagcactcgcttttctcaaaaaagacatagccttgccatataattcctgctcggcgtacagcatccccatttggttatataaccttccccagaattcataatcccaattctctccctcatattccaacgcacgtaaatagcattccaaagctagggacggttgatccatatcctcatagactttcccccggtaaaaccaagctttgggaggccagtaacagcctcgtgtcgtcctataataatccgtagcgatagagattatggaatccgatgtatgcctcaatcccgcctcatcccgtgattcggtccataacagacaataacgggctttctctcgaagcgataatccattgatatccctcactttctctaataacaccaaagcactgtccggatgatgcggaatcaatttctctacctgccagaacaggttgccatgcttgtcgctcctatatgaaaaaagcacaagaaccaagatcacgatcgtaaataataagatcgtaaacttgatccctatggaaaaatgccgtgacccattcaaatccttacgcatataggcaaatgtatataaattattcataaggaaagccttttccttccgcattattccatgtgtcgggacacatgccctgacctctcccattaatgcagaaatatttctttaatcgtttgcgcaatatatggatttagcatacctttgcgtgataattacatagtttaagtagaaatttctaaatacaattaaataacttaaattattatcttatgtggttacttaattcttctatcgggaagaagctgataatgagtatatcaggcctctttcttgttctgttcttattgttccacctgtcgatgaacgtggcggccgttttctccggagaggcttataacatggtttgttcgctgttgggctctaattggtacgctgtggcagctactctcgtattggccgcaggcgttgtgatccacttcgtgtacgctatcattcttaccttgcaaaaccgtaaggcacgtggtaacgaccgttacgctatcaacgctcgtccgaaaggcgtggaatgggcatctcagaacatgttcgttttgggtttgattgttatcctgttcatgctgttgcacttcagccagttctggtataagatgatgttcgccgaattgatcggtcatcacgaagttgcattggggtcagctatggtatctccacaagacggagccgcttttatcaactattacttccaaggtaatgccgtgatcactgttctttatttgatctggtacgtggctttgtggttccacttgactcacgggttctggagcgctatccaaacaattggttggaataatacgatctggatgaaccgttgggaatgtatctctaagatcgtagctacggttatttgcggacttttcgcgatcattactatcatcttcttcctaaacggagtaggtgcttaattgcaagctacaggttttataattaagaacttttgaaattaaatcattatgtctgaaataaattctaaaatacctcaaggcccgttggctgagaagtggactaattataaaaatcaccagaaattggtgaaccccgctaacaagcgtcgtttggatgttatcgtagtcggtacaggtttggccggagcttccgctgccgcatctttggcagagatgggattcaacgtattgaacttctgtatccaagattctccccgccgtgcgcactctatcgccgctcaaggtggtatcaacgccgctaagaactaccagaatgatggtgactctgtttaccgtttgttctacgatacgatcaaaggtggtgactaccgtgctcgtgaggctaacgtttatcgtttggctgaggtttctaactcaatcatcgaccagtgcgtggctcaaggcgttcctttcgctcgcgaatatggtggtttgttggataaccgttcattcggtggcgctcaggtatcgcgtacgttctacgcccgtggccagacgggtcagcagcttttgttaggcgcttattcagcgttgagccgtcagatcggtttgggtaaggttaagatgtacactcgtcatgagatgttggatgtagttaaggtagacggtcgtgctcgtggtatcatcgcccgcaacttgattacaggtaagatcgagcgttacgccgctcacgctgtagttgtagctacgggtggttacgttaatacgttcttcttgtcaaccaacgctatggcatctaacggttccgccgcatggcaatgctacaagaaaggcgcttacttcgctaatccttgtatggttcagatccacccgacttgcgtaccggtgaaaggtgacttccaatctaaattgactttgatgtccgaatccttgcgtaacgacggccgtatctgggttccgaagaaactggaagacgctaaagctctacaggccggaacgaagaaaggtaaagatattcccgaggcagaccgtgattattatttggagcgtcgttatccggcattcggaaacttggttcctcgcgacgtggcttctcgtgccgctaaagagcgttgcgacgcaggtttcggcgtgaacagcacgggcttggccgtattcttggatttctccgacgcgatcaatcgcttgggtaaagaggtcgttaagcagaaatacggtaacttgttcgatatgtacgaagagatcacgaacgataatccatacgagactccgatgatgatctacccggcattgcactactcaatgggtggattgtgggttgactatgagttgatgacctccattccgggtctgttcgctatcggtgaggcaaacttctccgatcacggagcgaaccgtttaggtgcttccgctttgatgcagggattggccgatggttatttcgtattaccatacacgatccagaactatttgtccgaccaaatccaagttcctcgcttcagcacggatctgccggagttcgtcgaggcagaaaaggccatcaaggatcgtatccaaaaattgatgaacgtcaagggtaaagaaaccgtagacactatccaccgcaaactaggtcatatcatgtgggaacatatcggtatggcacgcgacgcaaaaggtttgcaagaagctatccagatgctgaaagacttgaagaaagagttctggagcaacgtattcatcccaggcaacgcagacaacttgaataccgagttagagaaagcattacgtgtagctgactttatcgagatcggtacattgatggcacacgatgctttggaccgcgctgagtcttgtggtggtcacttccgtacggagcaccagacagaagaaggtgaggccttgcgtcatgacgataagttcatgtacgtatcttgctgggagtaccaaggcgaggacaaagatcctgtcatgttgaaagaggatttgaactatgagttcgttgttcctcaaacacgtaactacaagaagtaataatcatcaatctcagaaaaaattagaatcatggataaagatataagtgtaacacttaaggtttggcgtcagagaggtccgaaggagaaaggacagttcgagacatacaaaattgagaagatcaatcagagtgtctctttcttggaaatgttggatatcttgaacgagcagttggtcaacgagggtaaggaaccgatcgtattcgatcacgactgccgcgagggtatctgtggcatgtgttcattgtatgtaaacggacacccgcacggaccggcaactggagctacgacttgccagttatatatgcgtcgtttccacgatggagagacgatcacgatcgaaccgtggcgttccgcaggtttccctgttatccgcgacttgatggtagaccgctacgcttacgacaaaatcatccaagcgggtggtttcacatctgtcaacacaggtggtgtacccgacgctaatgcgatacctatcccaaagaaggacgcagacttagccatggacgctgccgcttgtatcggttgtggcgcttgtgctgccgcttgtaagaatggttccgctatgttattcgtatccgctaaggttagccagctggctttgttgcctcaaggtaaagtcgaggctgctcgccgtgccaaagctatggtcgctaaaatggatgagcttggcttcggtaactgtacgaacacacgtgcttgcgagatggaatgtccgaagaatatctccgttagcaacatcgctcgtttgaaccgcgagttcatttgcgctaaattacaagactaatatttgattagtatatcatggaaaaggcgtctttctctaaaagaaaggcgcctttttgtttttgttatatgtcgtaaaacataatttagcattataatccttgacaggaattgaaaagtccgtatatttgcatcgtggttttttcataatagtattagatttaaggttaacaaagtttggttagggcttgtcgtgagacaggctttaattgtttatagacctaccttttaaacatggaccataaaatactgcaaatagagattgtttagcgtcattttatcgtcgatctttgcctttaaagatcatatagtatatgctaataagtattttatttggcttcttatgttattttctccgggtgttgatcaaacacaaggaaaaaatcatgcgccagataagacaaatggtaaaacaaaaataaaatggacaaaaaacgaaccaccagttctttcagggcaatgagcacggaaagaaaactcgagtcgatcttccttttcgtaacaggccgatgcaacgccaaatgcgcaatgtgtttctatgcccaagaaatggataagaagcaacccgacctcactttcgatgaaatcaagaagatatcagaaaccgccgggcaattcaatcgattatggatatccgggggtgagcctaccttgcgtgaggatctaccggaaatattggagttattctacaaaaacaaccatatcaaagatgtgaacatccctacgaacggcttaaaaccagaccggatcgtcgaatgggtaaaacggttccgccagaactgcccggattgtaatattaacgtaagcctttccttggatggtttcggtacgacccacgatacacagagaggcgtaccgggaaacttctataaggccttggaaaccctgcgtaagatacaggagaatttcggagatgacggcaaagtcttaaaaaatatagcaaccgttatcacgaaatacaatatagaccagatagaagacttcatgacttgggtatacggacgtttccgtacctccacgcatacgattgaggctgccagaggcatgacccgtgacgatggcgtgaaaatcctaaccgagtcaacgctacgcaaaatacaagatgacatatcccctatctattctgcttatgcggatcggatggtagcggataccaccggcttaaggaaaccgatcacacgcttcttctatctcggccttatacgtaccttatataatgtgcgtgccagcaacatagatcacccgaccccttgggggatggattgtacggccggagagactaccttggtaatcgactacgacggacgttttcgtgcctgcgagctacgggaaccgctcggaaatataaaagagtatggttgcgatataagtaaagtgatgaatagcgaagcgatgaaacaggaaatagtcgctatcggacatgggtataaagccaactgttggtgtacgcacggctgttggatcacctcatccatcattttcaatccacgtaagatgattcgctccgtatataaaggataccgggaaacaaaacgattgaatcatcccctagccatcaatgagcagaaactacaaacgatggaagccaaataccatctggacatcgagcgtttgcgtcaactgaatatccggtaaacaagatcctcatagcccataaataaacgtagcatgaaaatactattagtaaccagaggctcacaaggcgacgtccttccttatttggccatagcggccgaattggaaagacgtggccatgaggtgaccatcaatctccctcaaatattcgaggagaccgttaaaccctacggatttaaatacgtattgcagcagtttgacgatatcggcggcatgatcgatagcgcagcgcaaaactcacataaattccggccattccttaaatggatgaggaacgtgatcgataaacagttcgatcaattgattcccctactaaaagagcatgatattttagtatcgaccaactcggaatttgctgtcgcaagtatcgccgagtattgcaagaagcccttgatacgtaccgcctacgccccgttcttgccgggtaagaagattcccccggccgtattgccatttcccaaacccaacccgatcatcacccctgccatcttatggaagttgatgaaccggatgaccaatttcatggtcaaagacacgatcaacaagaaccgggctaaatacggactcgcaccgattcgtaattttggttatcatgcgggagagcgttcatataattacttgcttttcagccagcacctaggaaacatagatccggactggacgttcaaatggtcgatcggaggctattgcttcaatgacacttttcaatatgatgagaaggcttacgaggaaatgatatcattcgtcgacagcgctcaaagccctattatcttttttaccctcgggagttgtagttccaaggatggtaaccgttttagcaaagccttggtcgatatttgcaagaaacatgattatcggctcatcatcggttccggttgggcaaagacaggaatcaccttacaagcggataaacatttattcttaatgaagcagccggttccgcataatttgatatttccgcactgcgacggcgttatccatcatggaggttgcggcacgacccatagcgtaggaagggcgggaaagccccaattaatcactccgttgattatcgatcaaccctattggtcctatcgaatccaccaattagggttagggccggaagggcttaagatagcgaaagcgagcgagcaggagatcgaacgcaaggtttgtgatctggtcaccaatccgctttataagaaaaatgccgctcatataggcgagatgatccaaaaagagggaggtataaagaatatatgcgactctatcgaaagatttcaatgaggcataagttcctattagattttattacatgttacaaaacacaatttagcacttaaactattgacaaataatagtaactccgtatatttgcatcgtggttttttcataatagtattagatttaaggttaacaaagtttggttagggcttgtcgtgagacaggctttaattgttttataaggtctgcttcccgcaaagcccttcgattacatcagaataatccgatgcgtcaataaagttgatatcttgtcttttaagatcttcccattaatcggtttcgccgtataggcatcaaatccactattaatgatccgttgctcatcttgggcgaaagcataagccgtcaccgcgataataggcacgctagcagaaaccttacgaatctctgcggtagcctcgtatccatccatgaccggcatctttatatccatcaagatcaactgaggtttgtgctgataaaatagctccacagcctcctttccattccatgcatgaatcaatttatattcaggcttcaatatagactcaaacaggcgataattactggaattgtcctcagcgatcaagatcgtaacctcacttcgggcgatcttctccaaagtaacaggcttctgctcttcactaggcaataattctttcttcggctgaaaaggcaatgtaaaccagaacctagagcctttcccttccacggaatcaacccctatcgttcctttcatctgggtaacaatcatctcacagatacttaaacccaatcctgttccttgagcgaaagtgttcagtttcacaaaacgtccgaaaatatctttccgtttattctccgggattccgcagcccgtatcctctacatagaaccacaacgtattatcatccttcaacttatagccaaataagatcgatcctgcctgcgtaaatttcatggcattgttcaacagattgatcatcagttgggacagacgatttcgatccgtataaatcacgcaaggctccagataatccttaaatgagatctgtacatccggattcttattcttcaaatgagccgattgctccaaatccctcaatacagcgttaatatccacatagtcataagtaaactccaaggtacccgcctcgatctttgacaaatccaagatatcgtttatcaactgcaacaatagggaattattattctcgataatatcagcgaattccttcttatcctcaaggtcatcggtcgaggcaaggatattagagaaacctactatcgcatttaacggtgtacgtatctcatggctcatatttgctaaaaacgctgatttcaatttattcgactcttccgccttatccctagccattcgaaggtcatgttccaattgcttacgctcggtaatagatatcgtagacccgatcaacgctttcggtttaccggaagcatcatattcagccattacctgtatctcctcccactcatggcgatcttctcccggaatcaaccgctccagacaatattcttttcgtactttctttattttcccattacacaaatcatcgaaagccttttccacgcaagccctgaaagacgggtgtatcttgctgaaatattccttcaacgaaacctcatgggtatgcacctctgctgtctctatattatctcccggatgtactttcgactcatagataatcttcccttcagccagattatatcgccacggtaaaagatctgccgcctctaacgccatagccagcttatgattcatggctttcaaatgcgtctggaaattatggatatccgtaatatcaataaaaaacgcatcaactacattctcttccgaggtaggcatgatgataatcgtatagtaaagccctgtcggctcaaaataatactcacaagtaaaggatttcccactctccagaactgtaggcacagccgatagaagcaaaggataacttcccccaattaaattagcgatctcttttccatgcttatttaccacgaaatctttaggagcgattttttcctcgaaagcatggtttacatccaaaacctgcacatcgatttgcgtaccttcccgaatcagccgctgccgtatataaggcaatggcatattattaaataaatcacggtaacgggataatagcctcaactccacttccttcatcttttgcttagaacgatacacgtaatgccacgctaaaaacactactaccagaaagaaaatcagaaagcctaatagcggcatccaatatttttctaaaaaagagggaggcgcattcaaatagatcgcatcatgtgggaaattatcttcattagacatcgcgctcatcagcgaaacataattcaagtatttacgaggatcatccaccgttgaaaccgggatcttgcccatatcttcaccgttataaacttgctgtagcaagggaattagagcagtctcaatcgttttagcgctattataatatccaccaatcgtatatccttcttccacgcccatatcatataaagaaaaaacaggatgcctagaaatgccgtttataccttgatacaaagtactatataataacgagtgattcaagaaaggtttctcggtaatccacgagtaatacatcacggctgtcgctcgatgcggatctttctccgacagaaccgccaataaactatccatggagcaagaaccctccgtataaaaatccactttcccctcagggaaagaagtttccatatgtttctccatctcatcccgaagccatgtggaaacataacgtctgtcggatatgaaaatcagacgtctcaaacccgggattaattccttaaccaagtcgatcgaacctttaacataataagggataaccaatcccgtagcgttataccccttaaccgcctcttgtaaaggaatcaccctatcagaggaatgcctctgattaaaatagcattcatcttctgccatttcacccgtttccgaacagaccagagtgggaatatccccccatttctcccggatcttatcccgcataaaagcccatccatttacgcctaagtagataattccatccggcttcttcttgttagcttcaaagaagacctcttgtttctcttttaatttctctggcgtatcaaccaacatcacgcttatatgatctatccggagagtgtactcctccggggtagcgaacttcgagatcatgtttaataaattgccagaccagcgttcgccatccacatatgaatttattaccaatacatacgattcatccttgaccggatatgaagaactcccataagccggagtcggcataccggctatcaagcataaaatcaatccaaaataaagtattattgcctttaaatttataatatttcgtatcattccctacattcctctattgcagttgtaaagacaaagatattccttaattatcaactaatcttatcaaactcgtttttttatcaagttttggtgtcaaattcacgtttcttacaaactaaaggcttttttaatcgggattattcggttatttaccgatactcgtatagaaatcagcggtatttacttgtgtatagaatgacgaacccgtacatttgataaaaaacaaaaaaatggaacttatggatatgaaagattatgacatcgattttaaagagaagaggacaaacgggtatctgatcgctaccttatttatcattgtcggtatattatttttactgcggaatctaggaatgatagatccatctttatttgacttgcttgtatcttggccgatgctgcttgtcgtgtcgggcatctttatgattttccaccgtaatccggtaggaggtatgctcctcgtgggcgtgggagtctatttccttttcccgcagttaaattggatcacgaacgatttcttacgtatatattggccgttaggattaatcctgttaggattggtcatcatgctgaagcggaaagattctatccgcacgaaaaagcataaacgtccttttaaccatccccctttcgggcacagaaagcctaacgatgagatcaactacgagacagataacggtttcgtatcggttgacaccactttcaactcggtaaggcacatcgtactggaccccgtattcaagggggcggacatagacgtatctttcggcaacgtgatcctcgatcttaaaaaaacaacattagaggctgatgaaaccatcataaacatagatagctccttcagcggcgtagtaatatacgttcctaaaggatggctggttcgtctaaaggttgattccttcttggctggatgccaagacatgagggacctgacagaaacaaccgacatgacgcacacgttatatatatgtggagacttgtcgttcagcggccttgaactaagagactaaactcatcatgcaagaacatcctattacaacatccatattacataaagggcagggaagcctattactacttttagccatagcgatccaatgcgcattattaactctttatggcgatcttccgttgagcatcactttggtcgatagcctactttccatcgcattgttcgccgtagcgggatattatctttggtatgtacaatgtacgttacatatcatgcaagcacgagtggctttcgccgtactcgtacaaatcgcttgcatagccggatgctcgatcttgctacaaatattcggattggaagattgggaggaattctcgatcacgattccttttcgattcctgttcggcctaatggcatggatcattctatcccaatggtatgccagccgggaaagaaagagtgaggcggaacctatcgggagacaaatggaggaaaagacggcacctcccccgactaccgttccggaggagattctagatcgtatatccgtaaaagacgggacacgtattcatatcatcccgataaaagagatattctatttgcaagcatgtggcgactatgtgaccttattcaccacttccggtcagcacgtaaaggagcaaaccatgaagtatttcgagcgaagccttccttctccggagttcgttcgtatacatcgctcttatatcgttaatacggaacagatattgcgagtagaactattcggaaaagaaacctatcaagtacgattaaaggatggaacctatcttcgtgccagtagcgctggctataagctactcaaagaacgtctttccctttagcagtcctataaaagggacctaatcatcgttaaaattagaagattttgattgtaatatatagagttttgtgttgtgtaacactttttggcaagcattgatatgttacttaacatatattagttgcaaaagacttgacaaatggtcttgacgaacgtatctttgcatcgtggttttttcataatagtattagatttaaggttaacaaagtttggttagggcttgtcgtgagacaggctttaattgtttatagaggtttgcttccctagatttacatataactataaaaaaacggccacccctaaaaagaggcggccgtaattattcttaatgaaagaacctactctttgacaatccttgtaacttccaaatcaaagatcaaagtcgtataaggctttattatgacacttcccgaagcactccttccagccgaaccgtatcccatctgttgaggaatccaaatctcccaacgatctcctgggtgcatattctgtaacgctgtagcaaaaccatctaccatctcagaaacagtaagctcggcaggggcacctgcctcaaacgatttatcatcaaaaaccgttccatcaataaacgtccctttataataacattccaccttgctcgtataataaatcggctccttactctctcctgtcttcaagaccttgtaaaggataaatccggcattactttgagaactcaattgctcgaaacccggaaccagcatctgggcttgaaaagcctcctcattctggaccttccaaacctcatccacctctagtgcctcatcatcatccccacaagaggtgatcatgagcacgcaaaacaacatcaacgcgatatgccagtacttcttcattcgtttactctattacctttttcaataaattcttcatgctcaccttctccgtgataatatcgtgaagcttatcgatgcttacgcgctcttgctccatcgtgtcacggaaacggatcgttacgcaattatccttcaaggtgtcatggtctaccgtaatacaatacggggtaccgatcgcatcttgacggcgataacgcttaccaatagaatccttctcgtcgtattggcaacggaagtcgaaacgcaacatatttataatctcctcagctttctcgggcaggccatctttcttcaccaatggcaatacggccaacttgatcggagccaaggctgcgggcaacttcaataccacacggctctcgccattcgccaacgtctcctcgcagtaagaacccgccatgatgctcaagaacacacggtctacaccgatcgaggtctcgattacatacggagtgtaactctggttcaactccggatcgaaatattggatctttttaccggaaaacttctcatgctgactcaagtcgaaattcgtacggctatgtataccctccacttccttgaatccgaacggcatctcgaactcgatatccgtagcggcgttagcgtagtgagccaacttctcatgatcgtgataacgatacttctgatctcccaagccaagagcttgatgccattttaagcgagtagacttccatttcttgaaccactcgatctcctcacccggacgaacgaagaattgcatctccatttgctcgaactcgcgcatacggaagataaactgacgagccacgatctcattacggaacgccttaccgatctgggcgataccgaacgggatcttcatacggccagtcttctgcacattcaagaagttcacgaaaataccttgagccgtctccggacgaagataaatcttagtcgctccatcagcggtagaacccatatccgtagagaacattaagttaaactggcgaacctccgtccagttacgagttccggaaatcgggcaaacgatctcgcaatccaagatcaattggcgaagatcctcgaagttagactcgttcatcgccttactataacgctcatgaatctcattccatttcgcttgatgctccaatacacgaggattcgtctcacggaatttagcctcatcgaaagcgtcaccgaatttctttgcggctttcgccacttccttatttattttctcctcgatcttgcccaaatggtcctcgatcaaaacgtccgcacggtaacgtttcttcgagtccttgttatcgatcaacggatcattaaaagcgtcaacatggccggaagctttccagatagtagggtgcataaaaatagcggaatcaatacccactacattctcatgcagcaaagtcatgctatcccaccaatatttctttatattattctttaactcaacaccatactggccataatcgtataccgctcccaaaccgtcataaatctctgaggagggaaatacgaaaccatactccttacagtgtgaaactaatttcttaaatacatcttcttgtgccataatctaataatttgccaattttgttaatatgccaatgtgccaatgataagtccatcggagacccgcctgagtgacacattagcacatggtctcctttatgcggctacaaagtaaatgattttttccgtaactatagaaagttttgtatatttacgacgtaaatcgttagtgtttgcgcaaacagtataatttaaacaagataataccatgaaatcagaagaaatctcacgccgctcgttccttaagcgagcgctagccttatcggcagtatcagccatcccgtcgttctggacacccgcccacggacgtgttctacctacttccccgctaatcagcgctaatgaccgggtaaatatagcgttcatcggcatcggacaacgagggggcgagatcgccaaggaattgtataacacaggtctgtgtaacgtggtagctctctgcgacgtggacatgggagcccctcacacgcaagagattatcaacatgttcccgaaagcggcccgttttcaggacttccgcacgatgttcgaccggatggcggacaagatcgatgccgtcagcgtaggcgtgccggatcattcccacttcccgatcacgatcgaggcgatggcgcacggcaaacatgtatatgtagagaaaccgatggcccgcacgttccaagaaatagagatcatgatgcgtggagcgaagaaatacggcgttgtcacccaaatgggtaaccaaggacattccgaggcgaactatttccaattcaaggcatggaaagaggccggtattatcaaggatgttaccgccattaccgcccatatgaataatccgcgtcgctggcacggatggaacccgaatattaggcatatgcctatgggagaaccggttcccgagacgatggattgggacacatggatcggcgtagcccaatatcatgattacaaccatgactaccatttgggacaatggcgttgttggtacgacttcggaatgggtgtcttaggagactggggagcgcatattttggatacggcacatgaattcctagatttaggattgcctacagaaataaatccgctttatttgaaagaccataacccgttcttcttcccgatgtcatccacccttctgtttaaattcccggaaagagggaatatgccggccgtggatatcacttggtacgatggactggacaatatccccgccgtaccggaaggttatggtgtctcggagctcgacccgaacatcccgaccgtagccggagggaagatacaaccggctaagttgaacccgggcaaggaaatctactcgaaagaattaaccttcaagggtggttctcatggaagtaccttatctatcatcccggatgagaaagcgaaagagatggaatcccgcttaccggaagtgccgaaaagcccgtctaaccatttcgcgaacttcctgctaagttgtatgggtaaggagaaaacccgctcaccgttctctatcgccggcccattaagtcaggtattctgtctcggcgtattaagccagcgcttgaaccgcaagctcgtcttcgatcgtgacacgaaacagatcacgaacgatccggaagcgaataagatgctgtgtggtttgccgcctcgcaaaggatgggaacaatattataccatttaattgtaaaatggagaattgaaagttatttgtttatcgctttgactttcaattctcccatataatttacaagcccatttgctacaatatctacaactatccctgcaatcatctggccttaggatatttagttcatggtggtagataaaaaacatctacaattatctggctctatctaccactatttactgctatttaccacttttccttcacctaacacaacgatcctctaccctcaccatatagcattatccaatctcctttcaacatatataaaatattagcatctagttatttgtagtttttcagcctaaaaaacaaaagtttttccatatgaaaacaaaagtttaataagcggaaaacttttgtttctctatagggaaactaaagtttcctcagtatgaaacttttgttacctctaagagaaacccacttttgcttttaatcccgacgctacgctctgcattttttgttatatttatggcaaatatagaaaaccataagaactaaaagaattttcaaattaccgaaggaaaagtacaaggagtgagaacaactacggaaggggtcttattgtataagggtatttcatgaagaacggaaatccgaacgaacaaggattggacgaataggccccctatacgaaggaaaaaacattcgtgatgacattccatatcgaataaagtcatcacgaacgccttcaaatatactcataggactccgagaaactcgactgggagctagaagaagctaattcttcagagactaattgaagcagattgccattctgatcataggacttcgtgatccgacgaagctctatggattctttttctgttggaaggtcggcataaaccatgatctccatgttcaatccgttctcattacggtactcgctatatcggagaacctcggacgtttcgggatcacgaatcgtttcttttgtcaacaaccctgtctcatcgtactcatagtccgtataagtaagcttccggccgagttcgtcgtactcaactttccgttccagaagattattcttataagaaaagactgtcaccttgctcttgccaataaccggatattcagtaatctcctttattttccgaccttgctcatcatacttataatgaagcgtagacaaattatgatacgtctgatctaggtttctgttgaagtaaacttctttagacaaaaaaccccactcgtcataaacatattcaacgtagccaatcaagtatccttctccatcctccgtattcaatggatgtaataccttggagatacgtcccgactcatcgtacacatattccttcgccagactctgaggagaggaaatacccgcaccgtaccaaactcgtgccaatttagctccctccggataaacaacactaggacaaatcaccggcttagcctcatcttgaaatgagtcctcgctacaccccagagtgcccagcaagacaaaaagcaggatgatcccacctatcggattgatgattctcataatatcttatttatttaagtttctataagttatagatgatcaaacaatctcaaaagctgcgtatctattaaaaaaagacaccgaatattcgtcagattcgtatcctatgagtgatttgccgttaaagcttgaacttatacccaaccgtcagactcatcgtattgtaattggcaccgacacttcttacctcatacagagagaaattatcgccatcgatcttatagttaccgccctcatcacctagagagagatcataccccagattcatcacccagttattcacctctataccaaaagaagttgtcaatccccaatcaaaagaattcacgtctcgaaatggatgatcggcgttttcagcctcatcatatcccgaatggccataaccataactataccctaggccagtagatttgacatatttaccaagcgcctgcggctccttcgaataccccatcgtaaacgaagatccccaattcgtatcattcttgacagatacaccggcatacataccgaccgctaaatgcatacgtacctctttcgacactttccatgagaaatcagccatcacgggcaattgcaaaaaatgttgcgtgataccaccggtcatcatctctttcaagacatacgtggcagactccgtcgttctcggataatctcccaacgaataccctctattcgcataatatagaccggatttcaatccaatccatcccggttcaaactggtaagatacaccaacgcctaccttaacccccgcacgccagctagagcccattccaacacgattaaccgcagcaaatccaccctccggagtaatcccccagcgtgattgagcgctcaccatcaagccgctcaaagcgcataacacaaataaaatcagcttcttcatatcatattcttttatatgtaaatatcaattgttattgataagacaaaagattctgaaaaacccctaccacctaaatatttattttataaaatctctttatttaacgcaaactcactctcgtaaaagcctcattcttataaaaactgccgaatatttgctatatttacaccctgttagcaatttggcgtaatagcgttgtgtagaaagaactggattttatgagaccggaagataaagaagacgattatatcgaggataaggaaaacgaggaaattgaggatataaatagtgatacccaagataacgagactacggaggaagaggcgaatacccattccgactataaagtcccggggaaaggggatacacgtgtcacgacctatcatttgtctgggatgtaccaaaactggttcctagactacgcttcttatgtgatcttggaacgggccgttccgcatatcaacgatggactgaaacccgtacaacgacgtatcctgcactccatgagaaggttggatgacgggcggtataacaaggttgcgaatatcgtaggtcatacgatgcagttccaccctcacggagacgcctctatcggagatgccttggtgcaattgggacaaaaggatctattgatcgattgccaaggaaactggggtaatatcctgacgggagacggagccgccgctcctcgttatatagaggctcgcctttccaagtttgccttggagaccgtattcaatcccaagacaaccctttggcagctttcttacgacgggcgtaataaggaaccggttaccttaccggtaaaattccctttattgctggcacagggcgtggaaggtatcgccgtaggcctgtcttccaagatactccctcataatttcaatgagttattagatgcttccatcgcctatctacggggagaggaattcgcgttatacccggatttccagacaggaggctctatcgacatagccaaatataatgatggagaacggggtggatcggtgaaagtccgtgcgaaaatcggcaagctcgataataagacattggtgatctcggagatcccgtatggaaaaacaacctctaccgtgatcgagtccatcctaaaagcgaacgataaaggaaagatcaagatcaagaaggtagacgataataccgccaaggatgtagagatcttggtgcatctcgctccgggggtttcttcagacaagaccatcgatgccttatacgcctttacggattgtgagatcagtatctccccgaactgctgcgtgatcaaggaggacaagccgcatttccttacggtcagcgatgtgctccgccactctacggatcgtacgttggagcttttacgggaagagctcaagatccagaaacaagagcaagaggaggccctgttcttcgcctcccttgaaaagatatttatcgaggagcgcatctataaagatccggaattcgagaacgccaagaacatggacgaggcgatatcccatatcgaccttcgtttagagccgttcaagccccgatttatccgtgaggttacccgggacgatatcctgaaactcatggagatcaagatgggacgtatcttaaagttcaactccgacaagagtaacgagttcatcgcccagaccttggaacaaatcgccaagatcaacgataagctggaacatatcgtcgactataccatcgattggtttaccatgctgaaagagaaatacggcaaggcttacccccgccataccgtgatacgcaatttcgacacgatcgaggcgaccaaggtcgtagaggcgaacgagaaattgtatatcaaccgtcaagaaggtttcatcggcatgggactgaaaaaggacgagttcatatgtaactgctcggatatagacgatgtcattatcttctatcgcaacggtacttataagatcgtcaaggtagcggataagatctttatcggtaaggatattctatatgtcaacgtatttaagcgtaacgacaaccggacgatttacaacgtcatataccgggacggtaagttcggatataattacatcaaacgcttcgctgtcacgggcgctacacgcgatcgggaatacgacctgaccaaaggtacggaaaactcccgtgtcctttacttcagtgcaaacccgaacggagaggcggagaccgtcaaggtaatcctgaaacccaaaccccggcagaaactactcgtcttcgaaaagaacttcagcgagatagccattaagggacggggttctcaaggtaatatcctgacgaaagcggaagtgcacaagatcagcctcaagcagaaaggctcttccaccttgggaggccgggaagtatggttcgactgggacgtactccggttaaattacgatggacggggagaagagctaggcgagttccatagcaacgatcagatattggtgatcctgccgaacggcgatttctacgtcacgaattttgaccttagcaatcactacgagtccaatatcatggtcatcgagaaataccagccgagcaagatatggactgccgtattatacgacgcggatcagaaatattattatatcaaacgattcctgctggaggtaaacacccggaagcagaatttcctaggagagaatcctaagaaccgcttgatgttgcttacggatgaggtctatcctcgtatcgaggtgatcttcggaggccacgacgccttccgggaagctctcatcctcgatgccgacgaatttatcgcggtgaaaggcttcaaagccaaaggtaaacgaatctctacatttgaggtcgagacaatcaatgagctggaaccgaatcgcttcgtcccttccgaaaacgcatcggaatcagacgataccgaaggcaatgaggagggaaacgacactgacgacgggcagagtaccacggatattatcgatgaaattacgggacagatgaaattgtttgacgaataacctatgaaagctatcacctgtttgattggtttgttcctgctgtttctcgcgtcaccggccaaggcccagtccgatggagacgagatcccttggtctatcaacagcgggaccatggtcggtataggaagctacaacctaatggacacctatttatctcccagcatggaagataagaaatatacaggccccggattacgggtaatgaatgaacggatgaagagggtccgactggcaaactatcgggtatccagacagcaaatcataagcgtcgatctggctagcacggataatgctgcctctaccgctacggatttcgcgggctttatcgattatacgttgggttactattatcatttgcccacggtattgccggatttaaagcttctggcgggtggtgccgtgcatggcatgagtggttttatatacaatacccgcaacggaaataacccggcctcagcgaaagcggatatcgatttgaacatctccgccatggcgatctataagttacgcgtcaaggaatatcccatgacgctacgctaccagttcacgatccccttcgctggtgttttattctccccccattacgggcaatcgtattacgagatcttcaacctagggaatgcctcgggagtggtgcaattcaattccttccataataaattcgccatgaagaactttttcacggtagatttcccggtttgtaattttacgatacgggcaggttacctaaacagctcttaccgtacagatgtcaatgggatacagtctcatataatctctcactcttttatgatcggcctcgtgaaagaattcatctctttcggaggaaaacgcctaaagaatactcagcggttcagaagcgcttattattaaaaggaaatcaaatgaaacgataccttatatatatatgtatatctctcggattcctgtttaccggatgtgagaaatcggacgaatacgtggcctccccacaggagaactttgaggcgctttggaaaatattggatgagaattactgcttcttcgaatacaaggacattaattggaacgaggttcacgaccgttataagacacagataagcgatacgatgaaccaatacgtcctatttgacgtattaggcgatatgctaaacgagctgaaagacgggcataccaatttgatatccaccttcaatatgtcccgctattgggattggtatctcgattatccggataatttcgactcggacatacaagagaattatctcggaaggaactactcgatcgccggaggacttaaatacacgacattgagtgacgggcagatcgggtatatttactacggtagcttttccagttcggccggcgaaagcggtttggatcacatattctatcaattcaaggattgcaaaggtttgatcttcgatattcgggataatggcggtggcatgttatcaaacgccgatcgcatcgcttcccgtttcttggaggaaaagatactgatcggctatatccaacataagacgggtaaagggcacgatgacttttccgaaccttatcccctttatctctcaccttccgagcgtatccgctggttacgccctgtcgtggtcttaacgaatcgtcattgctacagcgccgccaacgatttcgtgcagaaagtacgcatgatgccttatgtaacgacgatgggagatcgcaccggaggcggtagtggcttcccctttaactccgagttgcccaacggctggggtgtccgtttctccgcgtctcccatgctagatgtaaacaaacagcatacggaattcggtatcgatcctacatataaggtttctatgacccaagaagatatcgagaaaggtaaagatacgattatcgaggcggcgatcacccacctcttgtccgagaccgagaagaaataaggtttcgctaaaaaaacaacgcaaatatttgcaagtttataaaaaagcattacctttgcacacgattccaatgcggctgtggtgtaattggtagccacgtcagacttaggatctgatgcttcacggcgtgggggttcgagtcccttcagccgcacaaatccagaaatccttgtaagttcgcttacaaggattttttagtatggataaacctcctccatatatacaagcactgtgaagatcaaggattacaaacaacatccaaattgttaattttagaagattttgcgcatattctgtatagtttcaaattcaaaaacattttttacaccggactggcatgttgtttaacacaagttatactcaaaacccttgacaaaggggctttacaagcttatctttgcattgtggttttttcataatagtattagatttaaggttaacaaagtttggttagggcttgtcgtgagacaggctttaattatttataggggtttcattcgtttatagatgcttcccggcatcgattttatctttccatccaattccaactcaaagagcagagaagataattgatgtaccggaagattcaaggctacggacaattcattgatatgagattccttttgcgtctccaagaacgacaagatccgttcgctctcctcgttctccggaaacaataattgggtttggaccggtaacgcgtctgccttttgagcgacatcccaacgcatcgccatgattaaatcgtcagcgcaagtgatcaagcctcctttattctgccggattaagctattacatcccttagagttgatatccgttacccggcccggaaaggcatagacatcccggccatacgagaaagcgatatccgccgtgatcaaagagcctcctttctccgctgattcaataacgatcgtggcatccgccagaccggctacgatccggtttcgccggataaagttctgccgatctggattcgtcccgctaggaaagtcggtcaacaaacctccccgatccaacatttcgatcgccgtagagcgatgcacgggaggatagatacgatccaaaccatgcgccaatacgcccaccgtgggcaattggttcttcaacgcattccgatgggcacaaatatcgatgccatacgcgagtccgctaacgaccaatagatccgggaaactcacggacaaatcccgcaataaacgctcggtcacttcctgtccataagcggaggccctacgagtacccacaacgctgatgatatgggcggcgtttaaatccgcgttccccttgaaataaaataaaaccggagcgtccgggcattcccgcagacgttccggataattcatatctttcaagaaatagatagagataccgttcttttgggcaaaagccaattctttctctgcccgtaagagcacatccgcccgcttaatctcggcgataatcgaatcgccgatacccggtatcttctctagcgactggcgcttttccgtaaacacggcctccgcatctcccaacgcttccagaagatggcgggctaggatatctcccaccccattaatcatagtaaggccaatttggtaaatctgtttgtctgtcatttatgcttgttttgattctattcgctttagcatctcatcgaaatattctcctctggttaatttgccattctctacgacaacggattccacgactcctttagtagccagcgccccatcggattcccggtaaatatcttgctcgaacaccagtttcacccctttcttatatacattcaggcaagaagtataccgatcgccgctccgcaaggagttcttgaactggatatccacacgggccacaaaagcatcgatgcccttctcatgcatggcgccgaagttctcacccaacgactccagaaactcatgccgggtatgctccatataatgttggtaattggagttattcaccacgccttgcaaatcgcactcataatcgcgaaccttgtctgtcagtttaaaaatatattccttcattatcgtagttctttttcgatttgtactttctccattttataaagacgatcggacgggcggatcttctcggacatctttatcgagaagcgttcccctttcacggtctcctccaccggtttcaggtctacccggatctcatcgacggtctgcataacggctccggtcgtgggacctgttaccaagatctcatcgcctactctcaaggaaccggactccatctcaaactcggcgacaccgattccgctgaagtatttgataccccgtgccacgtacactttcttacgggtagcaccggagccatatttactgctccattcacccaatcgttgtcccagatagtagccatcccagaaaccgcgattaaagaccctgcgcagacgctcgtcccaaaccgctaccttctcctcatcgaaggtaccttcgcaataggccttgaccgcctctttataacattcggtcacgagacgcacatactccggcccgcgggcacgcccctccagcttgaacacacgtacgccggcatccatcatcttattcatgaaatgaatcgtcttcaagtccttcggcgacatgatatactgattctccacatccagctcgatctggctatccttgtcatgcaccgtataggcacgacgacaaatttgcatgcaagccccccggttggcggaagcgttcatctcatgcaaactcaaatagcatttaccggacacggccatgcacaaagccccgtgagcgaacatctctatgcggatcaattcccctttcggacctttgatctgctgcttcacgatctcctgataaatctcatacacctgctttaagttcaattcgcgagccaatacgaccacatcggcgaagcgggcgtaaaacttcaacgcctccacgttcgagatattcaactgcgtggataagtgcacctcttgcccgatgctattcgcgtaactcatagcggccacatcggcggcgataatggcggagacacccgcatccttagcggcgtctatgatctccctcatcaacggaagatcctcaccataaataaccgtattaaccgtgagataactcttgataccatgttccccgcaaatagcgacgatcttacgcaaatcctccgtcgtgaaattattcgacgagcgagaacgcatattcaatccctcgataccgaaataaatggagtcggcccctccttgtatagcagccatcaacgattcataggaaccgacaggcgccattatttcaaaatccttctctttcaaggttatatattttaatattacggtagcaaaggtacgaataatatttgagaagatttcttataagcacaaaccctccatcccatcatgaaagaatagttccagttggagaagcacaagatcctaaataaagcggggcaatccgagctctatcaatatatcataaatgatccggattattaaaaacgcctgttccatccaccgatcatcttacgagatgtaaaaattattccccaaaaagaagtacttttgtaatctctatttagttagcaaacagaaggtatgaagattggttcaatagatttaggggagcgtccggtattcttggcgcctatggaggacgtgacggatatctcgtttcgtttgatgtgcaaacgcttcggggcggacatggtatatacggagttcgtatcgagcgacgcgttgatccgcagtgtgaacaaaacacagcaaaaactaaatgtctccgatgatgaacgtccggtcgctatccagatttacggcaaggacgtagcctcgatggtagaggccgcacgtatttgcgaggaagctcgtccggatattttagatataaactttggttgccccgtaaagaaagtagcgggcaagggagccggggccggcatgctacgcaatatcccgttgatgctggaaatcacgaaagaagtagtgaaagccgtgaacatccccgtcaccgtgaaaacccgtttaggatgggatgccgacaaccgtgttatcgtggatctggccgagcaactacaggattgcggtatcgccgccctctccatccacggacgtacacgggcgcaaatgtacacgggcgaggcggattggaccttgatcggtgccgtaaaaaataaccctcgcatgcaaatccctatcatcgggaatggcgacgtgacttccgccgagatatgcaagcagcgtttcgaggactatggcgtagacgccgtaatgatcggtagggctagcataggccgcccttggatcttccgggaggtaaaacactatcttacgaccggggaattattgccacaagagcctttctcttggtatctggatatcctaaaaaaacaagtggagcaaagcgtggaacgattggacgagcgtaggggaatcttacatattcgccgtcatctggcagctactccactcttcaaaggtattaccgatttcaagcaaacacggatcgccatgctacgtgcggagactgttaacgaattattcgaaattatgaataacattcctaaaaagtacggaatttcagaataacaagcttgatatatatcaaattgaaacctatttgcgatatctttacaataaaatgttacaaatactattgacgcatattataaaaccccttatatttgcatcgagtttttttcatagtattttagatctaaggttaacaagtctttgcaaggggggaatcgtgagattgtttcattgaggagcaaaaaaagccgcatccatattgggactagcggcttttttgtttttccggactctatatcctaaatcaagaaacttatcgtatctttgtcaataggtcacattaaatatttggcactatgaaccagactatttatcccagtcggtatacagaatttcgagaagattcgcaaggacggagatacccataaactggcctcctccctcgaactgacctatgatgaaacacactccttgctgagaaagcgttacgacggctatcatttcgtagccaacgtaccgggtatctataaccctttcagcctgctgaatacctttaaatatatgcggcctgaagattattggttcgagaccgggacaccttcttatttagtagagttactcaagcacacccattacgacctctatgagctggcaaataccgagaccgatgccgatgtgctgaacagtatcgactcaacctctagcaatcctgtccctgtcatttaccaaagcggctaccttacgatcaaggattatgattctcgctttggtatctataaagtaggatttcccaatttagaggtagaagaaggctttgtcaaatacctgcttcttttctacaccagtgttagcgccccaaagactcctttcgaaatcaggcgttttgtccgggaggtggaataaaaaagcctatgttttcgcacacacgctatacattattcgaaataaacccttacatttgcgaaaaacataatactataccaccatgagtaagaaagtcataactttcggagagatcatgcttaggctggctactccggactatttacgcttttgccaagccaatcagttcaacgctacttttggcggaggggaagcgaatgtcgccgcctcactcgccaactatgccatagagactgagtttgtaacccgtttacccaaaaatgacatcgcccgtgcctgcgttatggaattacgcaaacagggtatcggaacatccaagatcatttacggaggggaacggttaggcatttattttctggagaccggagcggtcgctcgtgccagcaaggtggtatatgaccgggctcattcttccatcgccgagatccgaccggggatgatcgattgggacgaggtattcaaagatgcctcttggtttcactggacaggtatcacgccagccatatccgaaggtgccgccaacgtatgcttggaagcgatacaggcggcaaaccgattgggcatcacggtatcctgcgacctcaactaccggaaaaatctctggaaatacggtaagacagcccatgaggtcatgccggaactagtagccggatgcgatatcattctaggaaacgaggaagatgccgagaaggttttcggtatcaagcccgaaggtttcgacgccgccgccacggaaggtgaggtacacgccgtctctttccagtcggtatgtacccaattaatggctcacttcccacgtgcccggaaagttatcatcacgctaagaggctccatcaatgccaatcataacacatggggcggagtgctatacgccgacaaccgattgtacgaatcccgccggtacgacatcacccatatcgtcgatcgtgtaggtggaggcgattcttttatgggaggccttatttacggtttgctctcctaccccggtgacgaccagaaagccttggacttcgcagtagcggcttcttgcctaaagcacacaatttacggagacttcaaccaagtaaccgtagaggaagtagaaaaactcatgtccggcgacacctccggccgtgtctcccgctaattttcaattctcaactttcaatttttaattcccaatatggctcgattcaataaaatacaaacattacaggctatcatccaaaccggaatggtgcccgtctattataataaagaggtagagatcgcaaaacaagttgtaaaagcctgttacgagggaggcgtcagagccttcgagtttactaaccggggagatttcgcccacgaggtatttggcgagctggtaaaatacgccgccaaggaatgtccggaattagtattgggcgtaggttctatcgtagacccggccacagccgccttattcatacagctaggggcaaacttcgtagtcggtccgctgtttaacccggagatagcgaagatatgtaaccgtcgcctcatcccttatacgcccggctgcggttccgtatccgagatcggctttgcccaagaaacaggttgcgacctttgcaagatattccccgccggaaatgtaggaggtccctcatttgtcaagaacataaaggcacccatgccatggaccctaatcatggcgaccggtgccgtggagccgacagaggagaatctatccgcttggttcaaggccggcgtgacctgcgtaggaatgggatccaaactctttcccaaagaagcgatagcgggaaacgattggcaatccattaccgatttatgccgcgacgccttatctatcattcaaaagtatcgccaagtatgaaaagctttttagatcaagatttcttgctccagaccgacacggcccgtgagttatatcacgagcatgcggcgaagatgcccatcattgattaccattgccatctggatccccggcaaatagcggagaatcaccaattcgaggatcttacggagatatggctgggcggagaccattacaaatggcgggcgatgagagcgaacggtattcccgaggaatatatcaccggagataaatctccttacgagaaattccttaaatgggccgagacgatgccttacacgatgcgaaatccgctttatcattggacgcatctggagcttagccgtatattcggaatccataaagtcttgaatccggcttccgccaaggaaatctacacaacttgtacggataaactacgtacccccgagtatcgtgcgcaagccatcatgaaacggatgaacgtagagatcgtttgtacgaccgacgatcctatagattccttggaataccatcaaaaaatacgttcaaacggatgccacactcgtgtatatccggcatggcgaccggacaaggtactcgctatcgataatttcaaggcgcttaatgactatttgtccaagctggaggaggctgccgataagaccatcctcacctacaagcatttattggaggctttacaaaaacgacatgatttcttcgccgcccaagggtgccggttatcggaccacgggttggatactttctatgccgaaccttataccgagcaggagattgaggtgatcttcctcaaggctcgtatgggtaaatcgctcacggagcaggaagttcgcaaataccgttcggcattgctatacgaattggcggtgatggatgcccggagtggatgggtacaacaattccatatcggcgcaaatcggaataataacaaacggatgttcaagttattaggagcagacacaggtttcgacgctatcgatgatcagccggtagctgtttccatcaaccgctttttcagccgtttagatcaagaagggctgttagcgaaaacgatcgtttacaacctgaatccccgcgacaccgagttgatggtagccaatgcctacaatttcaacgacggcagtgtacccgggaagatgcaatatggagcggcttggtggttcctcgatcagatcaaaggcatggaagatcaattaaatgcgctttccagcctcggtcttttaagccgtttcgtcggtatgctgacagattcccgtagcttcctgtcatatccccgtcatgagtatttccgccggatcctttgtaatatgctaggcaatgagatagagaaaggcttattgcccgcctccgagttttccttcattggacagatggtggaggacatcagttacaacaacgctaaacgatactttgatttctgattactgcaacagctttgcaacattttattcacaaacacttcataagaccttccactatactcgcacatattacgcctacttttgcggcagatttagataaacactaaaatacgcaaacatgaaacaacggctttatgatttcatccctgtcaagcatctatgcgtagggatgtctttatgtggcatagtggcgggtacccaaaccgctcaagcttctcccgtctttgggcaatcatcgggcttagaacttccgagtcccagcatctaccaacaaagtacgaaacagatttccggtatcgtcaaagaccaggcggggattcctgtaattggcgcgaacgtgatcgtaaaagggacgacaaacggagtaatcaccgggctcgatggagatttcctactggaagttccggaaaacgctatcttagagatcagttatatcggttatatgacgcaaagtatcccgataaacgggaaaacgaccttcaacatcatcctagaagaagatacgcagaaattggatgaggtagtcgtactcggttatggagcggggcaacgcaaacaagatctctccgcttccgtgggcgtgctgaacaacacggaagacttggtggcccgtccggttacctctaccgaaagtatgttgcaagggcagttagcgggtgttaccgtacaagcgaacggtggagacccgacggctacaccctcgatcgtgattcgtggacagggctcacagaatggcgataacgtattatgggttgttgacggtgttcccggcgcacccatcgcctctatgaatgatatcgagacgattgtcgtcttaaaagatgctgcctctgccgctatctatggagcgcaatccggagccggcggtgttatcttggtaaccaccaagaaggcgaaagagggcaagacctcgttgagctatgacgcgactttcggtgttcgtaaagctagcaacgtaatcgagccgttaaatgcggaagagcaactcgagatgcgaaaactgtcttacgcaaacgcagggcttacattgccgaccggttgggatttgaccaagaacccatgggtaggtaccacacgtaccaactggatggacgagatcttccgcaccgctttctaccaacgccataacgtagccttgaatgttggttccgagaatgcctccaaccgtgtttcatttgcttacgataacgatgaaggtgtattgatcaatactttcaacaagaacctttcacttcgttacaacggtaaattcaaactgaacaaatgggtgactatcaccgaagacgtggtttggaaaaacaacgaaagccgttcaaaagataccgacagtggttatacgggagttgtcgcggcggctatgtatatgcctgccagcgctacggtttacaatccgctggatggtacttacggtggaacaacgaccgaagacccggattacatcgccaaatatggctccaacttcgcggatatccacggagacgctgtcaatccggttcgcttgctggaagcggaaaaccgctatgaccgaaccagcgacatctggagtacgaccagtctggaactagctaatatcgttaccggcttgaagttcacgagccgtttcacttacaacctgaagaataatctatataagaacttcagcccgatccgtgacgaggtgggaaaaccctccttgacaaataatctggatgaaacgacttaccgtgcagacgcatggaaaacggaaaacacattgacctacgacaatacgtttaatgacatgcacaccgtgggtgtcttactatccactacggccgatcattacagcaagcgaggattagaggttaatggaaaagatttatctgacgaatccgcttatttacaatatctatcctatgcgaattccgtttccgcaaccgattatttgaccggtcctgacgcaaacgtatccttgatcgcccgtctggcttattccttcaacgatcgttacttcgttacagcctcttggcgtcgtgattacgcaggccgtctacctaaagataataactatggcgactttcctgccgtaacagccggatggaaaatctctaatgaatctttcttcccgaagagcgagacactgaatttattgaagatccgtgcttcttggggacgtgtcggtaatctaggatctatcggttataattacaaatcagctttattaggtaagaattattggtcggagcaggcacagtacggcgtagaatcgaacaagatttggggaaacttcgtctataactctaccgcattaaatcccaacttaacatgggaaacttccgagcaatgggacttaggtctagatgtgaacatgttcgacaatcgcttgagcatggcattcgactatttcgacaaacgcacgttcaacttgatccagtcgcaaacgatgaactggccgggaacgatcggtatcgatgccatgttagtcaatcaaggtgaagtccgcaaccgaggttttgaggcgcaaatcaattggaaccaacaggtaaataaagattggtcgtacttcgtttccggaaacttctcttatctaaagaactgggtttctgatattggggtaaagaacgcagacggaaccccgggtgtctggacaggtatcaccaaggacaatgcctatttcgatggaagttatcgtaaccttccatatatgtatcaaacagccgaaggagaaccgctggcctctttctatctgatcaagactgacggcatttttcaaagcgacgcagaggcagccgcttatgtaaacaaagacggaaaacgaatccaaccggacgctgtagccggcgatttgaaattcgtcgatgccaatggtgatggagtcatcaatgatgaagaccgtcaatactgcggtagcgctacacctaaaactacattctcattctccggaggattcacttggaagaagctttccgtaagcgctatgttccaaggcgtaggtggagcacaagctttatatgtaggtaaatatatggccttaagtgatgtagaaggaaacttcaaccgctcaaaagagatcatgaacgcttggagtccgtcgaatacagggtcgaatattccacgcttatcgaaaaacgacccgaatagcaactttagcacaccgtctgattggtatctggagaatgcttcttacttgcgtttgaagaacttcaccgtatcctatgacttgagtgatgttatcaggaaatgcgctcacctgcaagaacgcaacagcatgatgtcggtttaccttagcggtgagaacctcttcacgatcacgaactactcaggaatggacccggaaaccggcggttgggatgccttgaagtatccggtttcacgcgtattctctgtcggagtcaaattgacatactaatcgggtgttttaaaagatattcatattaacaaaggatcaaaatgaaaagatatattacagtattagcattatccgcattggtttgtagttcttgtagcgacttcctcgacgttcagccggaaggaaacgcaactacaacctcctatttcttgaatgatcaacaggccattgatgccattgacggattatatgaaagattccatcaagagggttgttacggccgtgagttattctgggaacagggagccgcatgcgacattgtttggggacgtacgcgcggttataactctttggcgaccttagcctataccggtgatgaatctcctctaagagatgtattcagccgtatgtattctactatgtcccgtgcgaattggatcatccaagaattagtgaagaaagaaaagggaacgacgctgaccgccgtcgagaaacgcagcttgggcgaagcttacttcagtcgcggttgggcacattatctgatcgcttatcggtacggtacggataaacaaggagtgcctttcgtacgttacgaggacttccccgacgattacgacaactccataccgcctcagcaggctaccgttatggacaattataaactgatcatcgaagatatggacaaggcaatcgcctaccttccaaacttcgaatcctatgacgctgacaaccggggccgggcacatcaggctgctgccgtggcgttcaaagcgaaaacttatgcttactgggctacttgggatgctacccaatggaacaacgtcatcgagatggtcaatcaattagagaacaactacaatcgagatctagctcccacatttgcggaactattctcgtctgacttgaaagattattggaacgccgaatatctctggactattccgagtatcggtggcgcactaccgggcggtaccgaattcccgggtattatccttgagaacaaaggctggggcaaatataatggttgggggcagatgaagccctcttacgacatctacgaagaaatggcgaaagatggtaaaggtaatgaccgtttagtacgctcaatcttggaatacaaccaagagttcccgttcttcggcgagacacgcaagttctggtctacctccgatcttgaagctggtttcatgatcaataaatacatggacgcgttcaaatactcagaccctgtaggtgaaggagccgtgagtgctaacggagactggcctacggtccgtgtcaatttcccgatcatccgtttcgcagaaatgttattgttccgtgccgaggcatatttaatgacaggccaagccgataaagcaaccgcagatatcaaccgtatccgcctacgctccaacttggtaccgcttgccggcaccgccacgatgaaggatctatatcacgaacgccgttgtgaattggcttttgagtttacagaccatctattcgacttaaagcgttggaaccgttcttccaatgccgacataaagacattggccgataaagagttgaacgcacatccacgtatccgcagatatgaagaccgggcgaatccggaatccgcgttcacgattattggttacgaagattacaccaacaaaaacgcctatcaagcacatatgatggtattcccgtatccaagtgaagagattactaaatcgaatggtcaactgaagcagaacgagggatattaaccggctcctttaaaccgatcaaggaacgaataagattcaattacgggctgtctcagaaaatgaaacagcccgtgttattttctaccgggtaaaaacgcatatctcaaataggtagtttacctttgccaattgtataatatagtaaacaaaagatacaccatgagattaattcaaactctttcttcttgcttgtgtacagggataatagccttattcacggcctgtagccaagcaccacaatcccccatcgattccgtgaatccgtttatcggcacgggatttcacggacacacgtatcccggggccacggctccttacggagcggtccaactcagtccggacacccggaaagggaattgggacgcttgttctggttatcattacagcgattctaccttaatgggtttttcccatacccatttaagcggtacgggatgtatcgaccttggcgatatcctattccgtccgtcactccagacacctctagcgttctcgcactcggacgagaaggcttccccgggttactactcggtgaatctcagggaggcaggtgtattagcggaacttaccacgaccccgcatgtcgggatacaccgatatacctataaaaaagggatagagtctacgttggtggtcgatatggaccatttattggataacgaatatatatacgaaggctgggttaagcaaaccggggagaatgagcttaccggtatgcggcgtacccggggctgggtagacaatcagtatgtcttctttgtagcgcaattctcgcaacccttctcttccatggaacagccttccgaacggcaagccgtacttaccttcgatacgactaccggaaagcccatcgtctgcaaagtcggggtatcgatcgtaaatgaggagaacgcccgtctgaaccttgagcaagagacggattcctatggctttgatttcgacgccatccatcaagcgacacgctccaattgggaaaaagaactggacgttatcacggtagaaggaggcaccgaagccgagcgcacgaatttctatacggcgctataccatagcaagatcatcccgaatatagcgagcgacgtgaacggacaataccgccgtcacgacatgagcgtagcgacgatcccggcaggtcgccgccaattctccaccttttccacttgggacaccttccgggcctggcatccgatgatgactctgttggatactaccttggtgaatgatatggtacagtctctcttggatatgtacgacgccagcggcgagcttccgttatggcccttatcggcaggcgagaccgggaccatgatcggttatcactccacatcgattatagcggacgcttatttgaaaggtattcgcggatatgatgcggaacacgctctcgaagcgatgaaaatctcagcggagaagaataagaaaggagcggattattatataaaggaaggcttcatcccgacgaatatcaagaaagaatcggtttcctgcctattggaatttgcctacgatgattggtgtatcgcacaaatggcgaaagctttaggacatatggatgattatgagacgttcatcaagcgctcccagaattttatcaacgtattcgacggtagtacccggttcttccggggcaaacggcaggatgggaattgggagactcctttcgatccattcgccatcggacgttcctatacggaggctacggcctggcaatatcgtttctttaccccgcatgacgtatatggattgacccagttgtccggaggccgggaggcgttcatcgctgatctggatagcttatttatggttacctccgaggtagtcggcgatctggtagacgttacaggattggttggtcaatatgcgcatggcaacgagcctagccaccacatggcttacctatatagctatgtgggccagccctggaagacacaggaatggacccgtcgcttgctggacgagatgtaccagcccacgccggaaggtatcatcggcaatgaggattgcggccagatgtccgcttggtatatcttgagcagcctcggcttctactccgtatgtccgggtagcaaccagtttatcctaacgaccccgttgttcgataaggcgaacatgaagctgggcaatggcaagacattggtcattaccgccaaccagccggataagaacaagtatatcacgaaggttaccttaaacggcgaggagatatcgcattgctacatcacctacgaccagttgatgcaaggaggcacactggactttacgctctcggcgacaccggacaagcgttggggaaccgctcccgagtacgctccctattcctatacggagcaacctaccgtctctatcccttacatagcgaatgatctggatttatttgaaggagagattacggcggaactaaaatccacgacacccgaggcggttatccattacacgcttgacggatcggaaccggatgagaacgctccggtatacagcgagccattcgtcttaaaagagaccacgattatcaaggccaaaggatataaaaagggattcgtacccagccgtacgtactcgatccaagcgacaaaagccgtattacgccccgcgttatccatacagcctacgaagcatggggtagcttatacctattacgaaggagagttccaatgggtagccgatctgcaaaaagcgaaggtagtcgagaccggaacaatacctgagccttctatcctgaacgctaaattgccggatcatttcggttatatcttcaccggatatatatacgcaccggaagacggtgtctatgagttcagtacccgctcggatgacggtagcgtcctctatatcggcaaagaaaaggtagtggacaatgatgcctcccacgccgccatcgacgcgacgggacgcatccccttacaaaaaggctaccaccccttcgccttgcattatttcgaggattacgagggtgagtacctaggctggagctggcgtacgccaagcatgtccaaactagacgcgatcccaacagagaacctttatataaattgataatattaaatactgaatcatatgagaagaacaactctatccgtgctatccgccttagccatcctgctatccggcatgatcgttccggaggccgcggcacaaagtcgccgagacaaagaacaaacgtatgtactagagaaaccttacgaggtcaagaaactagtcccccctaccggaaagaaaataaagaacgtgatcctaatgatcggcgacggtatgagccttatgcacatgtattccgcttggaccgccaaccggggcaagctctggctggacaactcccaatacaccggcctctcgaaaacctattgcgccaaccgcctcatcaccgactccggagccggaggtaccgcactggccaccggccataaaacgaactaccatatggtaggcgtagacccggaaggcaagcccttggaatctttgactaccttggcgaataagaaaggcctgtcaagcggcatcgccgttacctgtcgcctatgggatgctacgcccgccgacttctgctgccacaatacggatcgtgacgccgaggccgagatcgtagcggattacgtgaactgtggcgtcgattacgtattcggcggcggctccaagctattcgagaaccgtgcggacggtcgcgatttgttcaaggaattaagggagaaaggttaccagactccccgtagctgggaggaactggcgaagatccaaaaaggcaaggtattctgcgttaccgataccgtagacaccccgcttcccgccgagcgaggcgatctcttggctcgtgcctcgatgaaagcgatcgatctgctgggacaaaacccggaaggtttcttcctgatggtagagggctcccaattggatgattacggacatttcaacgatatcgacctgttgatgcaagagacacatgatttcgaccgtacgatcggacgtatcttcgaatgggccgcccaagacggtgagacattggtcgtcgtaaccgccgatcacgagaccggtggccttaccttggtggacggggatctgaacgagggccgtatcgtttgtaaattctccaccggagggcatagcggcgtaatggtccccgtttatgctttcggcccgggcgccgagaacttcacgggtatcttcgagaatacggatatcttctggaagatcaaaaagctcctgaatctataatcaaacagtattcatccgatggagagtataacagggctatcccgctagtcaagtaccgcagtactttggctgagaggacagcagtacttgactagcagtactacggtacccgaccgggaggactgtgttcaccgactgaggcgcgccttctccctctctcccccaataaatatcataaagaatgacaacaagacgaaacttcttaaagcaatcccttcttgcggcaggcgcggcctccgttcccgccgggaaccttttagcgcaagagaaaatggaagagaaacgccccaaatacaatcttccttacaagaacacctacctgaaggaacccttcgtgaccgagaacgagttccggacggcgaaaccggagaccatcacgcccggaaccttcgaggaggccaagcaaatcctcccggacccgacttggagcggacacgagaaggaaatcgagatgtactggaaggcttggcaaatcggcatcggcaacatcaaggccccggaaccggattccggtttcgtatgcagttacctcgatgtcgcctacaacggcaatatcttcatgtgggactccgccttcatgatgatgttcgcccgtttcggtacccgcttcttccccttccaacgtacgttagataatttctacgccaaacaacatccggacggtttcatctgccgggagatcaaggcggacggagcggactgtttcgagcgttacgatccgaccagcaccggaccgaatatcctcccttggagcgagatcgtctattataagcagttcggcgatatagaccgcctacacaagatattccccgccctttgcgcttattataaatggttgaagctaaaccatacgtggcgcaacggtacgtattggaccagcggctggggtaccggcatggacaacatgccccgggtggaaccgaaatacaatccgatatacagccacggccatatgatctggctggacgtttgcttgcaacaatacttcaccgccgggcatctgcttgagatgggtttctatctggagcgttggcaggagatcgaggagttcgaggacgagcagaagatgctaaagaagtatatcaacgagaacctatgggacgagaaggagcatttccttttcgatcaatacgccgacggaagcctttcctccaccaagggaatctacgcgtactgggccttattgaccgatgtcctgtccaaggaacgcatggatgctttcgtggccgagctggataacaaggagacattcaaccgcctgcaccgcgtcccttcccttgccgccaaccatcctaaatacaaggataacggccgctactggcagggtggcgtatggccgggagcgaactatatggtgattaccggcctattgcaacaaggctatcgtaaattggcttacgagatcgcacgcaaccattacgataacgtcctaaaggtgtataagaataccggtacgttctgggaatactacgctccggaacatgaggagccgggcttcatggctcgcccgaatttcgtgggctggggcggactggcaccgatctccggcttgatcgagcaaatcttcggcatccgctccaatgtgtacgagaagaaattgaccgtagacgtgaacttgacggaggcttatggtatcgaccgttatcctttcggcctcgacggtctggtagcgatcaaagtcaagtcccgttcttccgctacccaagagccgcaggtagaaattaccagcgacgtccccttggaactaaccgtcctttggggcgacaaacagaagacggctaacgtaaaacccggcacgcaaaccgtataaaacagtaaatccatcaaacatccagttgtagagacggggcacgccccgtctctacaactagactcaaaaaacaattagtatatgaaacagattctatccttatttatcacctccctcgccctctgtacggcttgctcctccccgaagggatcggacacagttcaagtggcggagacaaccacggagcagacgattcagaaagcctcctccgcaattcattacaacgccttctcgcacaatgattactggcgggagagacctctgctggacgccttgtccttccgcttcaactgcgtggaggccgatctgtggctgatcgatgacgagctatacgtttcccatgaccgcccggaacccaatccggcaattaccttcgagaacctatacctcaagccgctcgtggcccgcatacaagcgaatggaggtaaggtctatcccggtagcgatcgtcctttctacctgatggtggattgcaaggcacaaggcgaagagatgtacaagctattaaagaaacagatggaaccttacaaggaatatttctgttccgtcgataacggcgaatataaagaaggtgccgtcctcttcttcctttccggcgaccgtccgaagaacagcctgccgaaagagaacagccgcttcaccttcctcgacggacaaataaaggatctgggacagggcatccctgcttccctcgctccggtcataagcgataattactccgatttcttcacatggaaaggcgaaggtgagatgcccgccgaccaactacagaagatgcgtgagatcatccggaaagtccacgatgagggaaaactattccgttggtggggcgccccggataccgagcagttcaaacgcttcttcatcaaagaaggcgtagacttggtaggtgccgatgacctgaatgggttatacaacgtattgaacgagcgttaaacgagaaaattacaataggcattataaggttgttacaatgggcattctagcatctttacaacaggcatcgtaacagccttataatgcccatcatagttttaacatatcacaaccgcttttattccaaccaaggctgcggattcagcttcgtcttttccttccacaattggaaatggaggatcgtggaattaccgtcctccggatccgaatagatccttccgatcgcttgacgggtagagacccggtcgcccgcttttacatatacctgactcaaattgctataaaccgtcaagtagttaccatgacgaacgattacggaattattataccccggcaccacgaacacacgcgtcacctccccattgaataccgcacgggcatccgccccgggtgaggtctggatatcgataccactattactggtacgaacatatttcaactcctgatgctgttgctcgccgaatgtagcgacgatcgtatgtcttccggccaccggatacggcaaacgtccccggttattggcgaagttatcggacaattgcttctccgcctttgtcatcgcatagccccctttcgtatccgccacacgttcctcacggatcggctcttttttactttccggtacgggtttacccttagcggcagcttgttcacgagcacgacgctcacgttccgcacgttcacgggcggctttcgcctcggcctcggcacgggcgatctcctcggcgatctgcttctctatctgtcggtttaaagcctcggcttgacgacgcttcttttggagatccgccttcaaatccttttgtctcttattcaatagctggacttcctctttctgagaagcttcctcactttctagcttcttactctcttcttgacgagttcctaaaagggcacgtttctcggcacgggtcttctccatctcagcttgcttacggctgatctcggcctgcttttcaacgatgtcattcgcttgccgcttctgccaatccgcatattcccgcaaataccgcatacgccgcatggattgagagaaactctcggcggataggataaacaacaatttatcttgcgagctatggcgtttataaagccctcgcatcgatttaccgtaattcgtctgcttatcgcccagttcccgttttaaggtgcgcaactggccttggatattcaagatatctttctcgatctcatccagctcttgattcaataaactgatgactttcttacgggaaagaatttgtttggagagtagattcaaacggttcagggaagttttagcagtctgggccgtctcttgcaataatttattcgtctcctcgatatcggccaacgcctccttgcgctgctgctccaactgacggacagcggcggatttctgaccgtaaaccacggtagataaagacaatgccaatagaacgatccagacgtgcctcatgatagattattgattcagattcgtaatcgttttcaatacttgcgcaaaggtaatacgcttatatttagaaggaaccgaaaaatccaacttgagcggctcgtccagttggatacgggagtaatggatcttcaccccaccctcgggattcccgttcttcaacacctgcacatccatcaacatcgggaacggctgccgatccaccaagcgaaaatcctcgtacagccattgcaaggcataacgatcggaaggatccgctacataggtagagagaagtttctcctcgccatccgccttaaaggtatagaaaagccccatggcatccttggtcttgatctcggctaccgggccttcttgattcagcttaaaacgattataatgcttacgggaaacgccctgctcccccgggataaacagatgattcgtgaaaagagcctgcaaattgtagaagttgaactcgatcggagtctgcccttgcaaattggaataattctcgatcatatagcgtttattcatgcggtctaccaccttgatcgtatcccggctcaactcgatacggaagatctcgatcccgagaaaaggttgtaccgacagttggaaagcactatccttgaccatcttcatatccacccgagagctcatttgcttaccagggatatccagatccacgttcaaccgggccgtcaaggtacggaactggaaggattgatcctccaccgactggaagaactcattatgagccttcacgctagcggattccaccgtcccgactttcttggacgatttacagcctgtcaacatcgaaagtaaaagacctccacataacaggaaggtcaagaaatagtctcttttcatttcgcgttctcgtcttctatatattgttgctcggcgatcttacggttcaagatctcggaatccttccccatctctttcgcctttttccattgctccaccgctttttccttatcaccgttcatgaaaaggatgtccccataatgatccacgagttcggcgctctttgtcttatctttctccaaagcgctctcgatatagattttcgccaaggtatagtttccttgtacgaagaagatccaagcgtaggtatccagatacgtggcgttgtccggttccagcttgatacattgggcgctcatacgttccgcctttttcaagtctttcttctccaaagaaaggaagtaactgtagttgttcagtacgaccacgttcttgtcattatacttcaacgcctcatcgtacgctttatacgcttgatccaattgccccatctggtaataaatatcaccgatctgaccgtagaaatccgatttcagcggcaggttctccttcggaatgatattcaagcccgcataataggtattcaaggcttcttgatatttctgttgttggtagtaagcgatacccagatagaagtaatattccggcgactcggggaaaagctccatacaagccgtacagatacggatgacctccgggatatcctcccctttcaaagccagattcagcaattgctgccaagccccggcgttacccggttccatctctgttaccaactggaactggaatttcgcctcctctgtctttccttgggccatcaagagaccgccatacatcagttttaagtcgatatcctccggatgttgctccaaaagagtttggaataaatggttcgcattctcagttccttgcttcgtttgttgcagtttcaagatataccgggaaaggatgttcactttcgtctccacgtccagcttctcgtttaccaaagcgctgcggatttgttgctcggcggcctccttatcccctttcgcctcgtagtaattggccatagagacgatataataagggtcggtcggatcaatctcattcgctttttgatagcaagccaaagccttgtccatctccccgttttccaaatgaagatcgcccaatacgatctggtaacgggcctccataggatatttagccgctagcttctcgatctccttgaaagcctcttccggtttctccaactggacgtacagtttgtatttctgcatggagatcgcctcgttcatacccataaccgactccaacgcatcataagcctcgatcgccttcccgatctcgccggcttgcgtcaaggcatcggccagataataattcagctcctccttctccggataatcacgaaccaattcctcgtactcctcggcggcttcgccatacatgcccagattccgggtgatagacgccaatgccattttatacgtgaaattatccttgctgttggccacggctcttttcaacatctcgaccgctttctccggacggttcaactgtacataaaaagaagaaagctcatacaagaccggagccgccgtagagtcaatctccaagcaatggttgaaggcatcataagcggcgtcgaatttcccggcgttcttcaagttcaagccctcataaaagaagtaatcgaatttacgttgatccttctccgtttctgtagcaccagccgggagcacagcgaccaacgagaggaaagagatgagatatatcagttgcttaaacatcctattattcttgttaaccttattattcttattcttttccggtatggccgaaccctccggctccccgctcggtatcatccaacgtctccacgggctcccaatccacatggctatgagcggctataaccatttggcagatacgctcaccatcattcaccgtaaaaggctccgaagatagattcacgagaataatgccgatctccccccgataatcggcgtcgatcgtacccggcgtattcagcagggttatcccatgctttaaagccagcccgctacgcggacgcatctgggcctcatagccttccggcagcgagatataaagtccggtcgggattaatttacgttccaacggtttcaacacaaccgattccgacaaattcgcccggatatccatcccggcagataaaggagtcgcataacccggcagcgggtgatgcgatttattgataattcttactttcatacttgcaaagataaacaaattgtcaatagtcaatcaattaacccaatccccgttctcttttattaactgaactaaacgttctacagcgtcttcctcggggatattcttgaggacacattccttacctttatacaggctgatttgtccacgtccggcacccacataaccatagtcggcatcggccatctcgccgggaccattcacgatacagcccatgataccgatcttcaatccttttagatgagaagtagcctccttgatacgggcgatcgttgtttgcaggtcgtacaaggtacgtccgcaactcggacaagagatatattccgtcttactgatacgggttcttgtagcctgcaagattccgaacatacagcgatccgagacaaccgcctcgcatccctcattgtgcagcatcaagccatccccgaaaccatccagcaaaagcgtaccgaaatcggcggcggatttcagttgcaacaactccacatccgtctcccggaaatcacgatgcaagacaaccggcacgtcacaacccgccatcagcaatttatgcatagccgcacgttgcgagccaaccccattccgatgatgtgtacttaataagaccaccacggtcttatccgctttcaagatctccaacatacgatccgtaagatccatatacgtcagacggataaacttaagcggacaatcgtaatcctttaactcctccgcctccgaggcgatgaagcaaggaaaagcattcggacgctctttccaaaaatgagcgtctaccaataaacggaaattatccggcaaattatccggatcttcctttcctatatatatatagtccggcaaggacaaataatcaaactcaaaatccccgctactacgatcggagatcacgactggcgagaaagtacctccgataccttccaccacacggcttatacgacggcttgtcgccaccgtatcgaaaccgggagccatcgaagcctcgataggacgatgattttcccgttccctaatataatccaccaatttacgcgctaccggcatttccgcctcggggtcctcactcaaggaaacccggatcgtatcaccgataccgtcacatagaagcgtaccgattccgacagcgctcttgatacgcccgtcctcaccgtcacccgcctccgttaccccaaggtgcaaggggtaatgcatattctcggcctccatcgtacgaaccaacaaccgcacggtccttaccatgacaacggtattggaagccttaatcgaaataaccacatctgggaaattctcctcccggcaaatgcgaagaaactccatacaactcgctaccatcccctcgggcgtatcaccataacggctcatgatacgatcggagagcgagccatgattcacaccgatacgaatagcggtgccatgtgccttacaaatattcaagaaagggacgaaccgctcacggatcctctcgatctcggcggcatattcctcatccgtatattcaagatggctgaatgtctttaccttatctacatagtttcccggattgatacgtaccttttccacctcaccggcggcggcatcagccgctctaggattaaaatggatatcagcgaccaaaggagtcgtatacccttgctcattcaattgtttacgaatctcgcccaagtttcgggcttcccgttccccctgtgccgtaaaacgcacatactcagctcccgcctcgatcatacggatcgcttgagctaccgccgcctccgtatccatcgttgatacattagccatggattgaatacggataggattctcacctcccataggtgtgtcaccgatttgggcaacggatgatttacggcggttgtaattaaagtaagccattgttcattgaaaattgagaattgaaaattgagaatgagtgttgagaactgaaaacctaaagagagactttctccttaattttcaattctcaactttcaactttcaattaattagttttgtatttaaaagaaaccttagccaactcctcgttagccttcacgattttcttcttcaaatcctccttataagcggatagcttctcctgaagttgctcgtcgccaacggcaagcatctgcaccgcaaggataccagcgttcaaagcgccattgatgccgacagtagccacagggattcccggaggcatctgtacgatcgccaacagagcatccataccgtccaacgtagagttaataggcacgccgatcacgggaactgtcgtcatggaagcgatcacaccgcaaagatgagcggccattccggcagcggcgatgataaccttgattccacgtcctttagctcctttggcgaaagcctccacctcagcgggagtacggtgtgcggatagagcatgcatctcgaacgggatctccatctcatccaagaacttagccgccttctccataacgggtagatccgaggtactacccatgataatacttacaacaggtgtcattcttatttagcgattaatttttgatagtcttcagcggataatagttcctccaactcagaagcgtccgtaagagaaatcttgattaaccaacctttaccataagcgtcttcattaaccaattcaggagcgtcttccaattcagcgtttacttccaaaacctctccgctaaccggcatgaaaagatcggaaacagtcttaacagcttcaatcgtaccgaacacctcttctttagcgacggtctccccctctgtcgtaatgtctacataaacgatctcacctagctcgccttgagcataatcagtaataccaacataagctacgtcaccttctacacgaatccactcatggtcttttgtgtactttaaatctgcaggaaaattcataattttagtgtttttattagatgaataaatagatataactcattaatgaggctacaaaggtacatataaatcccagacaaaaccccgcatatacctgcattggtgtatgcctttttaaaaagatacgcgaggtacctaataaaccggccacgatcaacacgactataaaagcccagtagggatttatcatatggatacgcgccactcccataataccgcccagtaacccgccgataccaatggcatgcgcgctaatcttccaagcgaaattgacgcataaggcgattaccaaggctacgcaagccccgatcagcatcgccaacaaccaaaacggcatcagcatcttatacaggaaaaagatacagaccaagatggaagtgataaaaatcagataaggaaccactcgttccttccggtcggaaagctctatatcgccggccgcgccatttttcaccaataagaaaatgaaaagtccgggaactatcgctgtcgaaataaaggtgcctccggcaatcagcagcttcacaggtaacgggtaaatggcgaggaatgtaaacatcaacgccaacacgatcccataggtcaccataagcaacggatggaacacgaaggatattatattcgagaatagcttcatacgcttttatatttcttttctcagacgagctaccggaatccccagttgctccctgtatttcgctaccgtacgccgggcgatgacatatcctttttctttcaggatcgtagccaactcctcatcggtcaacggttttcgtttgtcttcggcatctacatgctctttcataatctttttcacctcacgggtcgagatctcctcgccggtatcggtctgcatagactcggagaaaaagtatttcaacggataaataccgaaattcgtttgcacatatttactgttacttacccgggaaatagtggagatatcatatcccgcacgctccgctacgtctttcaagatcatgggatggagggtagcctcatcgcctgtcaggaaaaagtcccgttgtaaatagataatcgcctccatggtacgctgcaaggtctcattacgttgcttgatagcgtcgatgaaccactgggcggaatccaacttttgtttcacgaactgtacggcatcccgcctctcagcggtttggttcgccttattcgccgtataatcctgaaacatctcggcatactcccggttgatacgcatatccggtaccccccggttattcatgctcaagataagctctccattatgcgcttccaccacgaaatccgggatgatctggctcatcgccacttccatagaaccaccccaactacttccgggtttcggatttaacatagtaatctcgtgaatgaccttctttaacgtttcctcatcgatatcgagacctcgtaagatcttatcgtaatgtttgcgggtgaactcctcgaaatattcggtcaaaacacgaatcgccaaatttgtaaccggagtattctccttcttatccagctggatcaacagacattctttcaagtcacgggcacctaccccggcaggctcaaaatcttggatgatattcaagatagactcgatctccttctcatctacctcttgtccggcttggaagatcaaatcgtccgctatcgccgaaaggtcccgtctcaaataaccgtcatcatcgatatttccaatgatatactccgctattttcatttgcttatccggtaaatcccttaacccgagctgctgtaacagaaactcattcaaggattggcttacggagaaggggacatcctctttccgttccgcacgctcggtcatttcccgtagcttataatcaggtatatcgtcttccgttaaataatctcccaaagaaaggtcggtctcagtatcaacagaagggatctcttctcccccctcctcgctttcagttcgttcaaaatcatcaacaggctcttttccttcctccaaggctgggttatcttccagctcatgcttcacacgttcttccaactcgatcgcgggaagctccagaagccgtatcaactgtatctgctgaggggatagcttttgctgtaacttttgttgtaactgttgctttaacataatctaaatcattgcactgtaagggcaggacaatcacccgccctcttatttatcaacatgcaaatataagtttttagttttaacagtacagctattaaactataatagttctaaacaaggtgcatgacggaccctagcgactttaaaatccttccttcacgatccgtttgatcgggaggaagaatcgttcgatcaagcgtaattcttccgttacgatctccgcggaggcttgcgtctcgggcgagacgggcaggtcgataccgtaattggttctcagcccctctggaaaatcgatatccgccgtatagtactcgtcggtggggaccaatgagatattcgataccacgccgtttaccactccaaactcctgatccgggaaattggagaaacggacgatcgcccgctggcctctccggacttttcccgagcgtgctatcggtatgcgcaccttccccaccagccggccctcgccttgcggcacgacggtgaaagccacctctccggatgggatatattggttctcattccagtacttggtgaaagtcacgacaccccctaccggggcgatgaggcaataacgcaacctccactcgttcatgctgttcagcaattgttcccgggcggtctgtaattcctgccgtagcgtaaattctttctcgctccgctccagcgtcagatccagcaaggattgctcttgctccccgatctgtatccggagattctcggccgaggctgacgccccttccagcgaataacggctttgcagcagggaagcccgtgcggtctcatgctcgtaggaggaaatcacggaccggctatacaataatgaatcccgggcgtattgccgccttgtcaaggcgaattgctccgagagggtcttccgctgccgttcggtctcgttatagtaagccttatacaacgctatctgtttgcggatggaggccattttttgcggataataatcgatctccctgtaattgacgcaggcatggagcgccgacagtagtcccgagtaagccgcttgcatatcacccagcgatagctccttgtactttgataatgccttgtccaggctatccacgtcgcttccggatcgttccaacgccttatccagatagatggcatcgtccgtgtcggcgtgattctctatgaccgccagccaatccccctgccttaccggacgattatccctgacgagcagctcctgtatcttccccgccgcccgtgtcaccaccgccgttgcgggatgttgccccgtcaatgtcatgtcagccgtgatcacgtcaggatacttgaagaaacagctccccaccagcaacgctacgaccacgaggaataacagcgttatcccccaccgtacgatccaggccggcacttgccccatcacctcctgcacctcctcgctcctcagctctatgtccttatttcccttctccaactaattttcaattctcaattttcaattcccaagctccaactggttcttcaccaacttataataagtcccccgcaaggccgtgagttcctgatgcgtcccttcctccacgatgcgtcccttgtccagcaccacgatcttgtccgcgtcacgtaccgtgcttagccgatgcgccacgaccaccaccgtccgtcctttgtagaaggcgtgcaactgctccatgatctcccgctcgttgttggcgtccaaggcgttcgtggcctcgtccaggaagatgaagtcgggattcttgtacaccgcccgggcgatcaggatacgctgtctctgcccttggctcactccgtttccctccatgccgatcttcgtattatagcccagcgggagcgagtcgatgaaatcccggatattcgccaccgtcacggcatgcagcaggcgttccttgtccaccacctcttcgccgggggcgatgttgttggcgatcgtatccgagaagataaaaccatcctgcatgaccgaaccggtcttgctacgccatacgtgaggattcaagttcttgagggaggtatcgccgatcctcacgtcccccttgttggggttataaaaaccgagcaggagtttcacgatcgtcgtcttcccgctcccgctggcccccacgatggcggtcaccctgttatggggtatcgtcaggttgatatcctccagcacgtaatcccggtctgcgccgtcatagctgaagctgaggttttccagccgtagcgtcctgtcatcggggagaacattcagccttatcccgcctgcctgttcctcgtcctccttcccgtgtatctcgccgagtcgttccagactgatcttcgcgtcctgtagggaccgtgagaaatcgatcaattgctcgataggcgaagagagctgccccacgatgtaggtcaccgacatcatcatacccagcgtcatatccccttgcacgacggcccgtgccgcgatgaaggagatgagtatgttcgtggtctggttgaaaaagaccgccccgagttgctggtattgttgtaacgccaaccccttgatccctatcttgaaaagttttacctgtatccgttcccatttccagcgcatcttggtctcgcaattattcagcttgatctcctgcatgccggtgatgagctggaataggttgctttgttccccggccgcctgcgagaaacgctttacgtccagctccctcctccatctcatgaaagcgagtacccacgccacgtataacccgttacctaccaagaagagtcccagtatcgtccagtcgtaataggccagcacgaacccgaacacgatgaagttgacgaaagagaagagcgtattgatggatgtccccgtcatgaaagcctcgacgcggtcatggtcaccgatgcgctgcatgatatcgcccaccatcttggtatcgaagaaatgcaggggcagacgcatcagcttggcgaggaaatcggagatcaaggcgatattgatcctcgtgtttacgtgcagcaatatccagctccgtatgaagtccacggatagcttggcgataaagatcactaattgcgatataaggatcaaggttatgaaacccaggttgttgtcccgtataccggtatccaccaggctctgcgtgaggaaaggcaggatgagttgcagtacactggcggtcagcatgcccagcacgagctgtgccatctcacgcctgtagggcgatatatatcggaaaaagaatccgaggttacgtttcctgtctctcccctcgtcctccatcccgtagaactccggccccggttccagcaagagcgccgtcccggtatcctgcccgtccaccttggtactgacccagcaccgcttgaactcctccctcgtataggtgataagtcccgccgccgggtccgctatgtagaacttccctttccttatcttgtagcaaaccacgaaatgccattggttccagtgcagtatgcagggtaggggacattccttttccaattcctccaccgtgatccgcacgccctgtgtccggaacccgatcgcctccgccgcctcgctgataccgagcatagagaccccttcccgtgtgatgaaggctttctcccgtaagttctggatcgagtacacacgaccatagaacttggcgatcatacggaggcagctaagaccacagtcctttgcgtctagttgacgatatatagggaactctaaaatcacaaaacaaatctattataaaattcttgcatacaagaactaaatatttcagacgtataatatctctcatagcgtagacgagaatttttagccatttcttttcgcatagaagaatcttttaataatattaaaagtttagattgtaattcataggtatttaaatctgtgtgattctcatattcaatgattggtatatgatatcctgagactccatcctctatcatttctgataaacctgtagatgtacttgcaacaagaggtatcccatacatcatcatttcaattgccacataactacattgttcatggaatgatggtaatacaccaatatctgcgatttggtataatttgtataagtcttctttatttagttttccagtaaatgtaatcttattccatgttggattgcaagaatttaaatagtaagaataaaacccatctcctacaataactaaatggcaataagggtcaatttgcagtagttttttgaaagtaaaaattaattctcccagcccttttatttcatctaaacgaccaacaaaaagaataattttttcttctttactaaaaaggaaattctttttaagattcaatcgtttatcgctattcaataatatagattcatctttaagaccattatataaaatacaaaatttgtttataggtaaatcatatattttactcaatagattttgtgtactatttgacaagcaaataatcttatcaacttgttcaaatacatttttttctttttcgcatatttctttgatatttttttccaaaggatttttgatactgtctaattctttgtaaagaatactttttaaataagaataatttccttttattttaaagcaccaatccatataatgaatagtaaagcaacatcgtcctttagaaaaaaaagcacgaaatgtatttaacagatgaatgtgctgataataattgatatgtaatatgatattctctttactatgcgagctaaagtaaggaaatattagataccatatattcttataataagtttttattctaatttctggatcattattttgtatcgtatcaggtatatgataataatctatatctcctttgcgttctatataaaaatcattttttgttgaacgacaacatatcacgctaagatgaatcccttgcttctgtgaaagaattaaacaaagttgctttatatatgtgccaattccatattgggatgctctggattcttcattaacaagaataatctgtatcatatgcttgtcctattttattttgttttcaacttccctataaaaacgatacaattgtcatcatcagtaatttgattattcaacttcttcactttactcaatacttctgggaataatttttgagtggaagtcagaaccttttccaattgctcttttaatgcgtaaggttccatgatcgcagtgaaataacctcgattgaaggacggattggtaggcccatctatattccctagcatattccatttcaaattcacgaaacaacctttaaggctttgtttgtctactaggattttcgggaaacggggtaactcattattccatgaggtctgtgtataccaagtgactagaaagtgattgggcagctccgtgaaataatggcagatcggctcatgacccgtatgcatcgtaaaaacagggtgtagcgtattcgagtctatgtcataatgataaagtgtgtcttgcgaggctatacaattatgaagatagaagtcggaagcggtggtattcaaggattcccgtacctcataatcgtaagtgcttgggatcaacatgaattggtcggagaccggatattcttggatgatattgccttcgaaatcctgcgtccagatcaatgcggtgggagttccctgaaaaggtatgcacatgacggttactgtttttttctcggcattgatgacgaaccggcctttatgggttatataggccagaggaatgtgtttttgtggctgcccgtcgaagtcaaacactaatatcttagaggcacgaatctccattagatagattttattattactttcatctaaatactgatcataaataaataggttatattcatccggcccttgtccttgggaggagatctttctgatgaaatccccattacggttatagagcttacatgaagaacctgccctaaaagatttcacaaaaatataatggtcactcacggctatatgggtatcttgccctgcggcggtcaatgcgtcttccgagttttctaggcgaataacttgaaaggaagaaagcaaggagcttagcgataaattgaatgtatcctttacggaagaaaagtctaaattagtcaccggatctccttgcagattaataacctgtgctatgactgggcaattatccaaggtcaactttctggatacatttgtctctttatttccgcatgaggaaacaatcgttagtaacgtgatcgatacgtaatatatgattctattcatgaccttattgatttaaataacacatattatattcattggctactatttcataattagatatagaaggacatagatacttgtttacgcagtttttgcatgaaacataatctcttgtaaagaaccaaggtttaaaatagttttctatttcagaataaacaatttcagacaatttttgatcttgaatatttccaatcgtaggaaagtttacgttagaatacacttctcctgtagggaaaatggttaatttgccaaaaagattatcattcagtatttgttttctgaaaatatgctgttttgtgtttttttgttctataatatctttaaaatcattataaatatattctttgaagaaatccatattatctcctgtataccaaggtatataatcaacatttgtgaatttcccgaggttgtttttagataaaaaaataacgtcattcttattagaagcgattagactccaagtgatattatattcattaaataagtttatataactatttaactcttcataatctacaggtaaatgaaccattatcattattgaaaattgcggatttgttaacaattgtttcaaatcttctttgttgtattttttatatggtaatattatctgtgttttaatactgtactggcgggagagtgataacagataggaaaaaagctcttttttttctattgtagccggtatgatatttattttatctatttgacaaatagataattgttctattatctctagatattttgcatgtgataatttttgtttttctgtatatgtgggatataagaattgcttatagcaatctttatacattggatttaaatcaaaaccttgattttctaaataaaaggtcacttcatggagatgaaatagtgcattttctcccagtaaattgtattcttttgtctttggattattaggatgatgaagaatccgtaaaataggcttagagataaaaggtggaatacctctaatgtttttgattatatcacctgaaaatgtattccttatcttttttatgaattctgtaaattgcgaatctcttaattgatactcataaatacctacacaataggttttatttgtattatgaagaattgataagactgtatttattgtctttccatatagggaacaatcaatataagttgaatttaatgtattgtatattacatattgatttttactgtaaaaaagaaatgtgtaagattctaaatagaaccaatgagtataattttccatgttcaatctattaatatttcgttttctattctatctaataaatcaggatgcttttctaaagcgtatatgtaggtggaaaaatatcgattgacatcttcatttccaagataataaggacatacggtttgaccttcctcatctttgggtaaataaaacacgcagatctcacaatttttccacaacaagcattttttgcatttatcaactataggagtataaagtttcaaatacagttgtttaacttccttgctatccaaatttattttaccatctctcacatagcctagcggatactgttgtccaaccttctcgcaaggtaatattttcccttgtactgtcaaaaatatctttttagaaaaaggtacacaggtgcttgttggaaaatatttgatatctttatcttggaaaaataggtctgggatggttttgtaagtattgccaaaatacgattgcatgaaaatatctaattgcacaatatgggaatcatctgcaatctccttcaaatagctacttccacagtttaccgcttgctttatgctgtcttctttagaatgaaacattctattaaattcttctttcttgtcttcagcaattccatttctattcaattcagatatataaggtgttttgtcaaagttagtctttatgtagctataaatttgatcaacagagtttttatcgtgcaatacagagttgaaatttacattggaatcaaaataattaggatgattatcttttaattttttgatattagcaaatacaatatcgaaagactctttcccttccttttttacccgatatatattattctgtttggatccatcaatgcttatcaataaatgcacatcattctcgacaagataattcatatatttaggcaataatatcgcatttgtcgttaaattatatacaaatgttatcccctttatcttcactgcatttaagtagttaattattttttcaattaatatcatattgactaaaggttctcctccaaaaaatcctatgtttatggtattattgaatgatatattacgatatgatttccatagtgatattaaatagtcaattagaattttaacattattaaattcttgtttgcctctattgcgttcatcttgatttgaatataagtctccataactacagtatttgcaagataaattacattcatccgttacctcaataagtaattgatttaggtttgctaactctgattctatacaagaggtatcatattcaatctccatattggggatttttttctcgaaaaaattattctctctcaagaagaaatctttttgtttataatattcatatgcattcttgtccatatctatatcaacatattcattttcagagggagacaataatatgctatttatatatgaactataaatatatgtatatccggattttgatataactggttgtatcataatttattatttaattagcttttgatatcactagcatttcgcacatattgaaattggtataatagttaattgacattcaatatctatcttagtggaagtaagaacttcttatttctttaataagaaataagaagttctttaaagtgacagatatccgctataagatacatcttataacagaaaaatcttatcttacttcagaaaaggttagtaaccccatccatatccaccacccggagaataaagatctcctgaatgatttgcgctagcattagctgagccgcctccacctccgcaaatgcagcatccaccgcctttgagtttttttagctcttttttttctaactcatttttgctgagttgagaaagtttcaatttacgtacttgtttcataacgataaatttaaattgtttataaatatgaaattagccagaatagactggtgtttcttctaatatccatctaagtccatatcctgaacttccttgatgtagaccaagttcccatgaatggatatcctcatttttgggaaatgatcctataatttgcaatatagcttgttttttatccaatattatcttattattacaaataagattccattctaataaaaatagatcatcgaaatttgtatgaattgctgttatatctgcgttgttaattcgtatatttatataactagatattcccattagtcctgtctccaaactaagatcttttattcttcgtaaatcccgctccatgacttttttatcgatttctgtaaggatttcattggaatccccttccatgaacccattttgaattagatattcgattccccagccgattccacataatccagtctccagatttataggcaatgtctctggaatattctcgcagatttcttcgagcagttcccctgcaaagtcatcatatatagctgagtctgtatatcttgcgtagtgcgcaaagaatagcacaactcccatctttccatggaataaaccaatatcctctatgtcgattgaatgcaaaatcagatgattcgctattcttcgtaataatatgtctttttctgtattcatcttaccaacactcaattttagtatttaaatcttttgcaaagcctagcaataattctttttgataagttttgcttgatgtcaaacaaacaaccttacttgggtttaagattcgtaaaatcgtctcaaacgtatttgcgtataagaacagtctaggaaaattttgttcaatgctatcattctcaaataccttttgttcggaaaattcaacttgtacagctgtaactgtttccggtagttctgtatcatctggaatctcatattcagataataatagaattggaatctcttctttttgtaaaaaagtcgatatatgagccaattcttccttgtccactaggtaaaccaagcaacatcttttatatggagataaaagctttgtccaaagatgattatctatattaaagttatttgtggtattccttttcttttctatccattcaaaatgattcaagaaattagagatgttgtgaatagactcctcgatagattttccggcgatacgggaacgtatataatccatttgttctttcgaaatgaaagacagtatatatacgaacaatgcgttttttatggaatggttgccaagcatgagtcttagggtatcccggacctcatattcttgaatagcagttcttatatattcttgtatgattgtatcaaactcgattttgtattttcccaaatccagcgaactcatcttttcttgagactcctcttgtctccaattttccaatgtgcgccaaggaattgaatgacgttgcgcagaatagaaataagaaaacatggattcaaagcgtgaacgtatgaataaatttttccttcttttcagctttgaataattacatttcttgaatttttctagagaaatgaagcgatcctttgctttttcataccaatattgataagtttcagtgtgcttttgaagacatggacgtaaatgaaaccatatcagaccaccatcaaatagctttttattgtgaaacattacttccagaacttgattgtagccgggagcttttggcaaataacaagcttggtaggtcatttcttcagagacctcgaaaaagaaaagatctcgcactccgttgaatgggcatagaatgtcccggtaggttgtgtctatcttttcgtctcctaaaaaagtaagccattctccgtttttttgtaacacattgataccagagagggataccaatattttatcttgcttgattctttttttcaaataggaaaaatagaaaggaaccatctttatcgctaaccagtcttgccattttctttttggacttttgtcctttttaaaattatgcaggtaagatgtatatagcttataagcaatttgttccaaagggttgatccggactttttgctcggtgcggtaggcatcacaatattttttgaatgattcggaaaaaaatagctgatctgaatctatcttgatcgcatagcgataggttacttttgaaatcgcataattcgtgtatccggaaaggagatgaattgaatccttcggcaaattcatggtctcttggaattgttcatccgttaaatctataggatagatatagggttggtattcaaagattttgatcttgtaggggtatttgctctgttttcttttaagtatattagctgtctcatctgtacaattgtgatataccgcaatcagctcatctaatccttcaatacaggactctatgcaagcgtctaggaaatccgcactgttttggcagcgcaatatacccgttacccctaaagggcgttcttttgtcaattgtgataaatcgacagtgtattcggtatagtcctgttgcttagagctcatggtaattaaattattgattcatttctaattgattttgagaaaaacaagtttcccaaatttttttctgtatatagctctctctataaggactatatggcaaatctctttgtgcatcttctcctatgtactcttttctaaacattaaatatgtatgataatcttttagtgtatcgtcattcaaaatttctgtttcttgtatctttatatctatatccgataatacatctttgatctcaccggtaataaaacgttctcttaatagataggtgattccccatccaatgccacataatccatctgacaaatcaagagataaatcatccggaagctccattatagattctaatatctcgtccgcgaattgttcatataaagcatctccactataacgactgtattcataaaataggatagtcatgcctagcttaccgttatacaatccggtatgctctagagcctctgttttcagtaccccgtaacggagtaggtcttttagtatgcctttgtattgaatgaataactctttcatatcgttcattaattgtaaaatgaaaaattcgtaccccagctaccaaaaaaataatgagaacaatatgcttcctttattttttcatggaatgaggcggtctctccctgatagatatatgaacccatgtcatctttcgtcacaggcgttacttttgaataagggaaaagagtaaccttgtatcttttcttcaaggtattaaatatccgtgatatcatcaatgggcctgttgtatgcatcaccttttgtgctggatagtcccgtaacattgcatcagtaatttcttttaaaatgtctatccatcctccgcatcttggctcagaaaccataaatgcatttcctattagggtggacatacttgagttgaaattatgctccgggggctcttcgccaaatcctatcatcacgtcttctaataatggctcgataggcttaaaacattccgtatccaaatccgtatagactcccccatatacatataatatcatatagcgaatcgtgtcccaacgttgtacattgtatggaaaacttctatacatggaaagatactccggaaaatgtttttctaccaactcatccatttcctctccgttccaaaggtgatattcccaatctggattctgctctcgccaagttcttgccaagatttgtaagcgggtgggcatacatggttctgtacgcccctcccagacttgatgtatgattttagggattgccatatgctttatttaatctcgaattctccaactagccatcctaacttatgaatcaagactgcttggtatgtgtctgtttctatcccgtccaatggaatgttgataatatctcctgtttctccggaaagtatattctcatacattatattacctgcatgatccatgatgcggatcgttagatcatttaatgcttccgtgaaatgaacactcaaaatatttccttctatagataaggtaggaggtaatacgtggatggagcgataacgttcatcatcccatttcccgtgtgccgggatgtcatctccataagcaaatgtgatggagagaaatgatcctaaaagaatacataaggctaacaaatgtgttttcataacgctattactatttttattagtagtgtaattacgatttgtgttgataaagatcagtgaaaaagcaacagaaaaatgaacaaaaaacgaacaagagcataattatgcaaaaaagatttgtgcattttttgtttagttccttggctgatatctagtatagtgttataaattagatatatagcagtctagatctttggcatttcccttcttgccagttaacttctcatataatctttttcgataaatggaggcgtttcccaaattgagtaggatcgcgatcgctcccggctttacccctattttgatcagatagcagatctttttctcggattcgttcaagggaacagactcttgtaaacctatcgcaaagttggggaaacacgcttctaccgtaacgaaaagcttgttccaatcgtcgtttgttggagtccaagatatgggggagcgaaacttgtcatacaatcgtcctacctgtaattgcgctaacttctccttccttgtttcctcttggtttcttaaattggaattctctgttttgaggatggaaatgtctcgctccaggctttctttgatatgggataatttctcctgttgttgttcttttattttatgttcctgtatgtcatgtagcaaactattcttgacagaggacaagtcttttatctcttgctcttttttaaggatttgtttctcattgtcttttaatcgtcgtaatgcgttttttcgctcctgcctataacggatgaacgtgaaaatgcttcctactagtagaacatggcagcctattatggataaagtataaaagaacttctgttgggaagcgtaaagtcgtgcttcccataagtctcgctcaatgtcattgtatgaatagaacgcttgtacattccggatagattcggcctgcatttccttttctatagaatcccgtatcgactcgtatctatgggataatgaagctgctagctcccattgcttttgagcgaaggcgatttcttttaactggaaaagtcctccggcacgtgtcttaggcaaaggtgcggaatctgcgcatgcttgtaggtagaaacgagctgagtcaatttgacagttttttttataaagttcaccaagcactaggtatacgggatatttggcttgtggtttcactatattttgtaaagatgtctgtaataatccatgtgcttcttccaagcgttgttcttctatataaaggccggccaattccgtataaacggaagggaggatgttctttcccattaaggcgatcgctttttggttacagatgatcgcactgtcttgatatcccagcatcaagaaggttcggcctaagtcccgtaacgcaaatacttgccccattgagtcttttagcatacggaaatcctcaacggcctttttctgaaagggtaacgctttgtcgtaaaccgtttggtaggtatagagcatacctatattattattgattctgccgagtaacgcatagtccttaatctgttcctcttctctcaatgccttgagataatattcctgtgcctttaggggctgatttaagtcttggttgatccgccccttatagaaccaagctttcgcttttcgttccagatcgtctgtttcctcataataatccgtcgcgatcgtgatcagcgagtcggtttcatgcttaacaaaagtcttgtcttgtgcttctgttaacagcaaataataatgtgccttatcttttcgggataggttttctttgttctctatttgttcaaggagcattaacgcgctatccggatgttgaggcataaggttctctactttccggaagtctatggtttgatgccccatcccatcgcaagagatccatataataggtattagaattaacaggaaaacaatgtttttcttcatttgcgtgttatttgttgagggtaaaaataatacaaaaagacgagaatatcttggctggaaatcccgactttttggatctatttttattaccattaaaacatattgaataacagacggttacactagaagcaagtcatccgtttatggcttgacaagtgaataactaacggcttgtcaagtgaataactaacgagtaggggtagccgtcagttaacggcttgggaagtgatcagttattcacttgagaagccttttcccagagaagatatacttactttgccgatgaagtatatcttctccgggcatagaatatatactgcgttggccaagtaagtatatatggataaaaataggactttttcaccctaccagccacctctcgatattccgggtctcggaggagaaattcgcgccgatctttaagacctcccggtcgtctccggcgaagggtagggcataacctttctcctcgatctgccgcagagcctcctctgcggttccgttcagcttgaactccataatatagacgtagcggtcggtttgtaggacgaggtcgatgcgtccattcgaggtgtggtattccacttgcgtgtacagtccgaccagcttgaagacgatgaagagcacgttgcggtaatgcagctccgtgtcccgttccgggttccggccaataatcgcctcgtaagaggtatcggcgaagaagctttgtaggcggtggaagaaggcgtcgtagtctcctgcccgtacctctctcacaaagcggcctatctcgaaaggagacttcgaggcttgaatgttcgtatagaacggcagtaagtatttcatgaaaccctcctctacctcttggttggggaaacctaagcgatagatcttgaattccggctcgtaatccttgatcgtgaggtatccgctttggtagatgacggggatgggattgttcgaagcggagtcgatgctgttcaacacgtcggcgtcggtctcggtgttggccatgtcgtacaggtcgtaattcgttcgtttcagcaactccaccaagtaagtgggcgtgcccgtctcgaaccaataatcgctgagccgcatatacttgaaggtattcagcaggctgaaagggttataaatgcccggtcccccggccacgaaatgatagccgtcgtaccgtttccgtagcaaggatcgggcctcctcgtatgtccgctcaagggcagaggccaacgtatggatgtcctcatcgaaatgcgtacgcagctccgtttccgtgatgccgcaaatggcggcgtaaggctcccgcatggatatatcgtccagattgttgaggtcgctgaagacgcttaccttcccgaacttggtcacgccggtcagtagggcgaagcgtatagccctgtccatagtcttcaacacaccgtagaagggtttgagcatgttccggaaccggttttgcatctcttcgtcgtgcaagttctgtagcaagggcttgtcgtactcgtcgatcaggatcacggcccgctgtccggttttgcggtaggcccggtcgatgattccggcgaagcggaggggcagggtctcctcggtaggccgtgtcccatactcctcctcatatctggacaaggtatcatttaatatcttatacaagctgtcaggggcgtcgtagtgggagatattcaagtcgaaatgcaagatcggatgcttggtccactctttctccagcttctccatggccagtccctcgaacagctcctttttcccttggaaataggcctccagcgtggatagcagcagactcttcccgaatcgacgcgggcggctgaggaaatagtagcttcctgttttcaccaattgatagatcaaggcggtcttatcaatgtagagatagccgtccttgcggatcttctcgaagttctgtatgccgatggggtaaatagtctggttcatatcgtcttgtgtttaatgtgactcatagacaaagatatgaaaaaaacacgtacatgttttcaaaaaaagacgtacatgttttcggaaaaacacgtacgtctttttttaaaggctttatagagtatgattctacctagtacttgaagcttcctccccccaagaattcacggagcaaggaagttccgggaagttcctccgtcgggatgtaattaaagtagcggaggaaacggagcaaacgatacgcctccgcattcgccttactactctccggcacttgcgcgaggatcggttccgcaaatttgcgcaaggcggccagctcatacaacatggcgctgttaaacatagcgtccgcattctcctgatacggaaagatccatttatcctcaccccggcgaacgctcggccaacggttgatcgtatcttccgccgaatatcccctaaagcgataatcccggatgatacggcgcagcagacgattatccgtcgtcggtatccaattatggttatccaaagagatagaggtcaagaccgagacatatacccgatatttatatttatcatcgataaactccgtcagctccggattcaaggcatggataccttctatcaccaagatcgagttctcacgaagcttaagcttcttccctttgaaaacccgttggccggtctcgaaattaaaagtcggcaaatcgatctcttccccggataacaacttcttcaaatccttattaaaatagggtaaatccagcgcatacaaggattcaaaatcatactcgccatgctcatccttcggtgtatcttcccggttcaagaaataatcatccaaggaaattcctaccggatgaagcaggttagttgttaattgcacttgcaaacgcttgcaaaacgtagtctttcccgaagaagaagggccagagatcaagacgatacggatgccctctttatatccatcggcgatcttttcggcgatcttagcaacctgtttttcctgcatcgcctcagagacaaggattatatcctgagagcggcctttctctatcgctaaattcaaatcccccacattatctaagccgacagtccgctgcaatgtaaggtgttccttataagcctcgaacatcttatcctgcttgatgacaggctgcaattccatcggatcggtctgcttcggaatacggagcaaaacgccatccatatacggttccaagtcaaacaattggatatagccggtcgaaggggttaaacagccataaaagaagttgatataaccttccaactcataataagaggtataaggcaatcccgccgtctctattaagcgagccttatcattcataccccgctccctgaacaatacggcggcatccaccgtacggacactcttatggaggaaaggaagatccgcgtcaatcaactcccacatacgtttcttgatcctctcgatcgtctccagatcgatgttcttgccgttatggatcacgcaatagtaacctttcgacaccggatgttccagatttaaggtcgccgtcggccaaatatcatacaccgccttggaaaatatatggcaaagcgagcggacataggttctcaatccggataattgagtatagtcgataaattcgatatccttcggttgccagcaacggaagttcaagctttccgtcttattattcacttgcgcgttcatcggcctgtaccgaagcggagcgccaagcgccgtataaatgtccaacaacgaagaaccaatgggtacatccttgtaggtattattatttttgcagtaaattgttattgtctcagacatactatctcagttattatttgtaaattcgccccctaaagttaggaatattaatcggatatacaatccacttaaacgtaatttaaatggactattctttttttgattttctccggctgatcggctccttggcgctgttcttgtacggaatgaagatcatgagtgaagggttacaaaaatttgcgggtgacagtttacgtcgaatactaaccgcgatgaccacaaacagagtgaccggtgtgctcaccggcgtgttaataacggctctcatccaatcctcatcggctacgacggttatggtcgtgagtttcgtgaatgccggactcttgacattgacccaatccatcggagtcattatgggtgccaacatcggaaccacggtaacggcatggcttatctccgccctcggtttcaaggtcgatatcgccgcattcgcccttccccttttagctttcgctctcccactcttcttctcaggaaaaagctctcgtaaatcaattggtgaatttgtctttggtttcgcgttcctgttcatggggcttcaaagcttaaaggcaaacgccccggacctcggagcgaatccggagatgctggctttcgtgcagaattatacggatatgggatttttctccatcatcttgttcttatttatcggagcgatcttaaccatgatcgtacaagcctccgctgccacgatggctattacattgattatgtgcgccaacggctggatcgattatcatttgggagtcgctttggtattaggcgagaatatcggaaccacgattacggccaacttagccgcattaaccggaaacacacaagcacgacgagccgcgttagcgcaccttgttttcaacgttttcggtgtcatgtgggttttggtgctcttctaccctttcacgaatgccgtctcatggtttgttacccatgtaatgaaggtcagtgatccggctgtggcggtatcctttaaactggcagcgttccacacagcattcaatatcagtaatactttcattatgatctggttcgtaagcttgatcgaaaagaccgtatgtacgcttatcaagcccaaggtggaagacgaggaataccgccttcgctatatcacgggaggtatgttatccaccgccgagctttctatcctgcaagcgcataaagaaatctcattattcgccgagcgtacggctaggatgtttaatatggtgaaagaattattctacgagaagaatgaggagaccttcctcaagacttatagccgcatcgagaaatacgagaatatcagcgaccgcatggagatcgagatcgcaaattacttgactgaagtatcggaaggccgtttgagttctgaaagtaaggaagaaatccgtatcatgctacgtgccgtctcggaaatcgagagtatagcggattcttgtaataaccttgcccgaagtatcaaacgcagaaacgagttcaaatccgaattcacggaggagcaaaacaagcacttggatcatatgttcgagctggtatccggggcgttaaatcgcatgaacctaattttgcataaaccggaactcgtacatgatgatatcaatccttcttataacatagagaacgagatcaacaactaccgtaaccagttgaagagccggaatatcgaagatatcaacaataagctgtaccaatatcaagatggcgtttattacatggacatggttagtgaaagtgaaaagctgggcgattatgtattaaatgttgttcaagcggttatcgagaagaaaatatagtgtatatttgtccttaacaatatcaacagcccttttccgttattgagagaagggctgtttttaatatatatccactatgaattataagtattatacgatcgttatccttggccttttagcattctccgcttgcgagaaagatgatatcgatattccggcaaccgacaatgaagtaaatcaatggatcgagcaaacgatgcgagagaattatctttggtattccgagttcccggataaaagttccttggactttagtcttgatccggagagcttcttcaagggcctgttatccgataaagacgggaaagagctttctgatggccatcattacttctcccaattagagaaagcgaccgtaacaaagagcatttacgacgcgaacaactcatacggattcgatttcgcgacttccaaccttaaagacggaggcaggacctataaaatagccattgtcctttatgtattaaaggattcacccgccgaagaagccggattgaaacggggagactggatacttggcgtaaacggctccttgggttctatccaagactatgatgtgttgagaagcggaggcagcgtatccctccaactaggaaaagaaacaggaaacaccaagggattcgtctccacccgaagagttaccttgaacgcatcccgaacggtagaagacaccccattcctaaaagattccgtatacacatatggcaataagcgaatcggctatttgatgtacaaccatttcgcctccggaccgaatgaatacgattatagcgacactagttataatctttatttgcaacaactcttcgaaaaattcaaaagtcgcaacgtcaatgagttcgtacttgatttacgctataatgggggtgggcttgtcaattgcgcccaattactggcttcgctattagtccgtgaaaacgttttaggagaacctttatgtatcatggagtataacgataaaaactccaataaaaatgagaccttacctttgctcaaaacgaccgaggtcatggcgggaaacttaaacctacaacggctatttgttttgacaggttcaactacggcttctgcctccgaacttatcattaactcgctacgatcttatctagacgttcgggttatcggtaagcagacttttggcaagaccgtcggtatgacgatctacaatgaatctaaaaaatatggctggatactttctcccgtcactttccatatttataataaggatcgggaagctgattatgaagacggatttcatcccgatgtagctatcgatgaattcaagagtgatctagctgaattcggagatttgaaggatcctttattaggacaagctatttacgagataaccggccagtcaccgctcttacgatccgctaccccgaggggcaaccgggaaatccaatataatcccccgttgtcctataaggataacttattactgattccaaaagactaaaaacaagatatatggaaagcgcatttcttaaaatcataaacgcaaaagtattaactccttcgggtctcctaccaaacgggcaaatcatcatctcggatgggaaaatagtggagatcaccgggcaaaaccgggagattcctcatgcggagatcatcgacgcaaaaggatattatgtggctcccggctgtatcgacacgcatgtacacggcggcaacggacatgatttcacggaagctaccccgaaagcgttctatgcgatcacaagagcacatgctttacagggaacaacggctttatatcctacattggcagctgcccctatcgataccttccgggaagcgatcaagacctgcgagcacatcatgaaccacccggaacagggagcccgcatcatgggattacatctcgaaggcaactatttgaatatggctatgaaaggcggacaagaccctaattatatttacccgcccgatccccaagaatataaggaattactaaacagtacccaatgtgttaaacgctggagcgccgcccccgagcttgacggggctttggaattcggtaaatatgcgtcagctcatggtgtgttggtttcactagcccacaccacagccgattatctccaagtgaaaaaagcatacgaagccggattcacccatgctacccacttctacaatgccatgacttccgtccataaagaccgtgagtataaacatgaaggaacagtagaaggtatttatctcatgaaagatatgaccgttgaagttgtagccgatggtatccacgtaccgccggcaatcttaaagttggtatatcaaatcaaaggggtagaacgtacgtccttaatcacggacgcaatggccgccgccgcttgcgataacggtacggaacattttccggactcccgggtaattatcgaggaaggcgtatgtaaattagccgatcgctcagctatcgcgggaagtatagctaccggaatccgtttgatccgtaccctagtcgagaaagcggaaattccattgcacgacgctgttcgtatggcttccgaaagcccagcccgcctaatgggtcttttagaccgtaaaggaacattggagaaaggaaaggatgccgatatcatcattttcaacaacgatatagagattcaagagaccttcatcgaaggtaaacggctctccaaagaataagaaatccaataaacaatgacttctcctatcttgtttttagataaataagggcatgaatgtatatggaaaacgtaaaagaacattactggagatactcattgatcaccattatattaggactaggggtaattctattttttaagattaccccgtttcttggaggtatacttggagcattcaccatctatatattgctgcgtggacagatgttccatctgacagaaaagctaaatatgagaccagcttttgcagctttactgttactgggggaaacaatcttatgtttcttaatcccaatcacattggcgatctggttggtaatcaacaaaactcaaaatattaatttagacccgactgtactgctaaatacaggccaacatatagcggatctagttcaggaaaagaccgggtttgatgtactggatagaggaaacttattaaaagtggcctctatactcccacaaatcggacagtttttagtgggtagcataagcagtttcgccgtaaatgtcgtcgtcttgattttcattctgtacttcatgttgataggcggaagaaaaatggaaaactatctatacaccttattccccttcagtgatcaaaacaaggatgaggtactcaacgagatcaatatgatcgtaaaatcaaacgccataggtatccctcttttggcggttatacaaggtatcgtagcggtgatcggttactttatctttcagactcccgatccgctgttatttgggtttctcacttgtatcgctacgatcattcccattgtagggaccgcattggtctgggttccgttggcggcttatatggctttaaacggagattgggtacatgccttgggattggctatttatgccttgcttgtcattacgaacgtcgataatctgattcgttttatcctacaaaagaagttggcggatatacatccgttaatcaccgtcttcggagtcgtaatcgggttgtccttattcggatttatggggatcatcttcgggccgctgttattatccttattccttctttgtatagatatcttcaagaagagctatttggataaataaagagtatctacaggacagggtatcttaaaaagtcatacctttacactacattttgagtaaaatgaattaatatgtcacgtagaacagtaaacaattggaagcctatcaaggggcaacctctcaccgaattagacaagaaaatcctatatatccaaaataaaggacatttagtacccacccgcaagcttatcaagactccagagcagattgagggcatccgcagaagtagcgtgatcaatacaggggtgctggatttaatccagaaggagattaaagaaggtatgtctacagctgttatcgataaattggtgtatgattatacggtagggcatggagcgattccagcccccttaaactatgaggggttccctaaaagtgtatgtacctctatcaacgaggtcgtttgtcacggtattcccagtgagaaggagatcctaagagacggtgatattattaatgtggatgtctcaacgattttagatggttattattcggatgcgtcccgcatgttcatgatcgggaacgtatctccggaaaagcagaaattggtacaggtcgccaaggaatgtctggagatcggtatgaaagcggcgaagccgttcggattcgtcggtgatataggcaacgctattcaaaagcatgcggagaaaaacggattctctgtcgtacgggatttatgcggacatggcgtcggtctggaattccatgaggaaccggaagtttgtcatttcggacgaaaaggaactgggatgcttttagttccgggtatggtctttacgatcgagcctatgattaacatgggtacttggaaagtatttatcgacgaggaagacggttggacggtcatcaccgaggatgaactaccctccgcccaatgggaacataccttcttgatgacagagacaggattggaaattcttacctattaatatctaatgcaattaacgcttccgggccttttcccgggctaccttttccttttcccgcaaggcttccttgcgggctttttccttctctttcaatttttgcttgtataagcgttccttctccttgcgctctttttccttctgtttcaagcgttgcttataagcacgttctttttccttacgaaggtcctcacgagctttcagtttcgccttacggtcggcttccgcttgtttcagcttggctttgcggtcagcttccagctgtttctctcgatcagccttcgctttcaacagggcacgttcttcctccgcttgcttcttgagaagttcttcctgttctttcgctttctgctcacgtaattccttatccgccttttgctgggcctcgaaagccttacgagcctcttccttgcgggcttcttcttcggcagcttcccgtttacggatctcttggatttctttcaaggtcatgccttgatcctcaaccgccggctgaacaacaggaaccgtatccttacgaagggtatcgacaggctggatttccggtttgtcaaacgcagggacctcaatcgtatccgggacgactggcatagcaagctgtcggacaggttcttgaacagaccgttgttcctcctccggctctgtaacaggttgtttttctggttcaacttctggtttcaattcatctgccttttccggcacttcggcttcttcctccgtgatcatttcatcttcagtcgcctcctcctccttagcggcttccatacgggctttccaacgacctgccagatccggtaattcctcaccgaagctctcatcgaagaaggtgatatattcatccaaggtcttgccacgcatcaaggtctcataattatcatcagagatcggtaacacggcaaccgctttattcaaggccgtagcataaccatccttaccgtatatcatcttataatattggataatctcatcaaaactaataaatcctttaatcgccagcatactgatcgggccggcctgctccaaagccaaatcaaactctttcaccatgaagttcgcaaagttataagcggcgacagcgaatagcaactgattctgatctacgctacccgtaggatataccaaaagcatctgataaggcgtattccgttccggattaaatacacgggccgaatcctcggcagataacataccatcctcgcccaaaccgaatcgtaagttccaactcatacctttcacaccgccctgcaccaaggcacgtccccgaagaacacctttcaacatctccccggccagttccgtgacatctgcgttcggatacttctcgaccagcgctttcaaggcattcttaaagccttccgcatccccggcctgcacatatgataacgcatccaagaacatgaatttaggcatcaatgtagccaatggatatttctcgcttacgtaccggaaactcttacgtacatacgctgtatcgctctccagataacggtcgtaagtagcttgatagatcgagtcttgtaccacatccatcatgcggatattatactcgtaattcggatcagccacagctaccgcataatcgctttccgggaaggcgttcattagtttattcttatactcggtagccaacactgtatttccagttttcagggccatcaaatatacttgataatagctctccaaacggtgctcattatccgggaaacggcgttccaaattctcgaatgcctcgacagataaggggatatcctccaacttatccttatagatcatcgccatattgtaaagaccgtctataataataatgttagaagcgtctatatcctcttgcgtgaaaggtagctgctgtaggtaatactcacgggtatgcggatcatcggcggcaacagccgacaggtcaccgcctatcgaatcggtcggcaacggctcaccgtccggccctaccatttgggtggaatctccctcggccagcatctcctcatccagattctcattaaaggtagagagttccttcttacggcggcgccagtgatcttccaacggacgacgtccccatttacgctggaactgtgtctttccttgcgctacggtctgaggattatagaaatagaaagacgctccaccggacgcattcggcaagacaacagcattggtttccgtaccgggacggtcgattccggtgcctttcgcttcctgctcggccagataagcctccttctcagccaaggctttcgcctcttcctcctctttctttacctcctcaatcttcttatcgataatcgctaaccgctccgcttccggcaatttagccaaggcttgcaaactgtcttgaagatggaccgcttctacatgcacgaccaattcatccagaatcgccgacaatttagaaacccgttcataatccctgtattccttttgaattccggctaaggctccgctaaagcaaggttgcgctttcacgtaatcccgcatcgtaaaatagatatctcccagctttatctggcagatcgccttatccattccattcaatgtactcttatcgataccgagttgatagttctttatggcattcaccgtatcttcccggctgaggtatacatttcctaaagcatagtatacttgatccagataatccttattcttctggcttttcgccattttctcgagcatcttcaccactttcaaataattcgtacccgagaatacttctgtctgacggatacgtgaggcaaattccaactcatacggaggattcgaacgggctacctcaccaaaggtcttataagccaagccatctaattcttgatccgcatagatttgtcccaaaagatacttcatccgggtacgttgcttccggtttttctccgccttgatagcggtcttcagataagggatggcatcctcgaactgcccgttcttgatcaaataatcggcatacaccgccgcatattgcttcaagacggaagcaggaataccgttcttgttcatcttatccaagatatcctcggattcatagaaccaacccatctcggaataacaacgggcttgccacaaacgggcctcggccacgacctcctcgtccttcgcgtaatgacgggctatataggaaaaggtagcggaggcttgcaggaaatcggcattgtagaattgcgcctgtcccatgatcagccaactattctttaagaaagggttatactcctcttgttcttggatagcacgtagtttgggattattccgccagcccggtttcttggccggtttcgcttttatggagtgtagcttaatagctttattacttttctcgatcgtccggtcgaaagggccgcccggctcggctttgtctttaggctgggcgctaatcggatacatatagatcctgtcggaatagttctctttatatccgtcctgttggcttttcagtgcctcgtcaaacgcttgttttccattgaaataaatattataacgggtcgtaaaggcatgataaaaacggctcgctttcgtgttcttcttcgtgctgcacgaccaaagcaagagtaccgttaataacgccactatgtagtaaaacccttttttcattctttaattaacgccgtaacaacggttttattgctttcaaggccaaaaagaggaccaccaaaaacaagatgataaacgcaccggaaggcacgttcaggaaataagaaagaaccagtccggacacgcaacccagaaagccgatcgcgatacttccccatatgatcttcttgaagtcggaagtaaacaggtttaccgttatttgaggcaaggtcagcaaactcatcaatagcataatccctaccaaacggatcgaaagaacaattgtcatggcgataaagcacatcatcgtatactcgatccattttaccggtaggccttgcgtgacagcgaagtcacgatcgaacgccacgtaaacaatctcacggaggaaaagggagaatatgagtatcaacaataccaccaaccctaaaatccataagatatcggccgtagagatcgttaatatattaccaaatagataggcggatagattcggggcgtaccccggggtaaggaagatgaagatcactcccaaagccatacccagcgaccatacgcccgctatagcggaatcctcccttacgttttgcgtcttgctcgcccactccacgccaaaggcagagaggatcgaaaacaacatcgccatcaagatcgggtttgttcccagataaaaacccaagcccaaacctccgaacgaagcatgcgtgatccctccgctgataaataccaaccggcgggatacgatgtaagtcccgacaatcccacaagcgatggcggttagcaagctcccgatcaaggcgttctgaaaaaaggcatattgcaataaatccatatgattcgtttcctaaattaatgagtacggcgttcgccaatgatcaggaatgcctcatccttcaaggcatccggcaaattgatccctcgcaattgcaggctacggagccaaccggccacctccacttcccggagggtataaagcacttcactaaactcctcaacggcttcctcatcgtaagcgtccgcttccactccttggaaccgatccagttcctcatcgttataatattcgattttcttgctgacggcggctaataaactatcccgctcgcaagtctcatgttgtccgcagcaaacctccggaatctcctgtgcctcggggatctccgagatctccccccgttccagcatcttctgaagtttcttattccggaaatacccggcgatagcggctacgacacccagacctataagacttatgacaatgtaccacataattcaattgaaagttgagaattgaaaactgaaaattaaagggctgattccctaatagagaaaccagcggccttaagatcttcccaataatggggataactcttgctgaccacttgcgggtgggcgatctctatcccctcgggacgtaccaaagcggcgggagcgaatgacaaagccatccgatgatcctcgtaagtggcgattaccggatgcgactccggttccctgcgttcaccgttccactccaagatgctatcattgcgatccgtcaacacataacctaatttacgaagctctgtcttcaatgcctcgatccgatccgtctccttgatcttcaatgattgaagtcccgtaaagcggaaagggatatttaataacacgcaagtcaccacaaaggtttgagccaaatccggttcattcacgaagttataaaccaacttctcacagatatttccagtatgctttaacactactccacgtttcgtataagtagtgcccactcccaattgagcgaacaacttcgctccggcggcatctccctgcaagctattcttgaataaacctaacaattcgatctcagcatttttcgataacgccatgatctcataccaataagaagcggcactccaatcggattccaccgtaaaacgaatcggcttatactcttggggaagtactttgatcgtattctccgtccaagaggctctcactccatattgctccatcaattgcaaggtgatatggatatagggcctagagataatagcgccctccaaatgcaacgtaaccccattttctgttaacggggcgatcatcaagatagcggatatatattgagagctgacatttcccggtagcgagatctctccgccttgcaaggcgcttccgaaaatacgcaaagggggataaccctccttctccatgtactcgatccgggcgcctaaagcgttcagcgcatccaccaacaccttgatcggacggttcttcatgcgttcggttcccgtaatcgtccattcgcccaccaccttcgagaggaaagcagtaaggaaacgcatcgtcgtacccgccgcacccacattaaaatcccgatcgttcgagtttaatgcctttaccatcaaatttgtatcatcgcaatcggataagttctccacatcgtatgcgctataacttagcgcattcaagatcaatgccctgttactgatacttttagaagcgggaagctttacggtagtccggatagcggaacccggagcatctatctgataattcatcgctttcgtatattcaagattcaagaagcaaaagtacgaaaattagcgtacatatggagtataactgcgggaaactttctttatgcttcttttcgaatgcgaatcgtgacaaggcattcgtttgaatcgccccaaccagtagacgggaggggcaataaaacgcccttttaagtgagaatattcccgttttcaggcacgaaaggcgatgaaagcctacacgtatagtcgcgttgggcgacgccaatactgccgttaggcattataaacagtcacgaatagggttgtcagtagtcgtgaataggcatcgtaacccggttagaacccagtcgtaaccctatcggatagcccgaagaagtcaatggatatgaattaggatgaattattttcgctagaatgaaaggcggtttttcggtattgtattatcaatgaacgaattattgtttttttcttgcgtatttggcaacgagtcgtacatagtcccggaaaaatcggttctccgggacttcagtttacaaaatgtcagaatgtcaaatcgccaaacggtcttatcacaaggccttcatcttcaagaaatgcttccagaaaaagaggatctggtaatcaatagaattattccagtattgtgaatcatgattacccgggcgagtgataaagtcgtggtcgatgccttgttttaataacgcctcgtggtagttcttattcacctccaaaaagaaatcgctgtcaccgcaatcgaagatcaaagcgatctggtctttcctcaaggttggaaccaaattgataaccgtgtacttctcccagttttccggatattttgccttctcacctatttgtacgctcatctcccagtttttcgggaaagggcggatatccacgccaccgctagtacttcccgcagcggagaaaacatcgctatgacgaaggccattccacatagcgccatgtccacccatgctcaagccggtaatagcacgtcccttacgatcggccacggtcttataatgggaatccacgtatttcaccaactcatccgagatgaaagtctcataccgtacatcagcgttcaaagggctatcccaataccacgtattcttaccatccgggcatacgaaaaagatacccttctcatcagcgatcttagatagatccggcttgataccgacccatgtacgagcgttaccgccatagccatgtaacaaataaatcaccggacacgctttcgtcgcagccacatccggacttaccacgactacctctatacttttattcatcgaaggacttttcacttgcaaagtatctaccttcgccgcctgtaaaccgagcggaagcaaacaaaccaacgctaccgctacctttttcatccaattcatatcagtgaacattaatgattaattccccgtagccttgttttcaaggaactacggggacaaatatacagattttacagccaaaaacttatttacttaacgagaaaggacgatcctctttcgcggttcctctcgtcttctccggttgattgcccatttgaagctccagcacgcccccattcacgatatcgctgtaatggatataattacgtgtatgtctcttcccgttcaaggtagcgttttggatatatacgttatccttactattccctttcgcctcgatcacgaacttcttgccatcctccatcgtaatcgtagttttccggaatttcgggctacccaatacatactcatccgtccccgggcaaacactgtagattcccaacgcgctcaatacgtaccaagaagacataccgccttgatcctcatcacccggataaccattttccgagctattatataaccgatccatcacctgacgaatccaatattgcgtcttccaaggctggcctgcgtaactatacaagtaaatcatatgctggatcggttgattaccttgggcgtactgtcccatcttcgccaattccatctccagcatctcatgaattttcgttccgtatgttccatatttcacgataccgggtaaagcgaaaacagagtcgatcttcgccacgaaacgctcatcacctcctgtcaaatcgatcaacccttggacatcatggaaaaccgaccaattgtaatgccaagcattcccctcgcaataaggaccgccccattcgaaagcatcgaaatccgcccaactaccatccaatttacgacctctcataaaaccgacagatggatcgtacacattcttgtaattataaatctggcgggcaaagacctcctcataaaacttattcccagtcattttcgccaactgatacgcacaaaagtcatcatagcaatattccaacgtctgtgccgtagatcccatggattccggataaggtatatatcccaactgataataatccttccaacgaacccgtccgttggcaccgccccaaggtcccttattcatcgcctcatgcgcatacgctttcaaggctttctccggatcgaaagtgcggatacccttcacccaagcatccgtcaataaagagatcgagtgattccctaccatcccgccggtctcactcgggaacgaccaagaaggtaaccatccacattgctcctgagcgtctagcaaggcttgcatatattgcccctgcatcgtagggtgcaagatattggtcagcgggaactgggaacggaaagtgtcccaaaaaccattatcggtaaacatatatccatcatgaatcttctcatcgtacggactatagtagtaaggagaaccatcctctttctcctcataaaacttatgggaaaacaaattggcacggaacatgcaggagtagaaggttttcatatcctcctcggttccaccttccaccaacacacgattcaatagctggttccatacatcagcagccgcttgcttcgtcacttctaccgatgagtgcttacctagctcacgagtcatcgtaacctccgcttgctccggactgatataagaggtagagaccttggcctgtaccttagagcctttcgcaaattgtacataggcaccgataccttccccttcccgcctcaaattattcttctggatcgtattcttacgattctcccatgtaccatagctaacgaaaggtttatcaaattgaatgataaaataattcttatgtgtcttcggagagaaagccccattgtgtacatagccggtgatccggtggttcgctacatcgatttgtacctgactggttttcgtatagccatccagtacgagaaaagcgtctcccttcgcgggaaaggaaaaacggaaatgagcggaacgggtagttggcgagaactccgtggtaataccattctccaacgtaaccttataataatgaggcttggcaatttccttatcatgagagaacggagtcgcccgtttggactcatcaacaaccaattccggtacaggcatcaaagagaataccccgtaatctcccacccaagggctacattgatgcgtcggttggaaaccccggatcgtagtggccgagtattggtatttccaaccatcaccattcttcccggtctgtggagaccagctattcatgggatagggaaccgccgtagtcgggtaggtatttccccaactcaattcgtaagtcgagtttgttccttgcaaagtatttacgtattgtaccaagtctttctccgcaaaaacagggaaagagagggttaaacagagggctaaagccgccccctgtttataaaaagtattgagtttcatgttattttatttactgattaattattcacgccccaatttgtattcggctcggggcccatctccaattctagtacgccacctttcatgatatccctataatcaagatagcatctcgtataatccgtcccgtttaatttagcggattggatataggtgttttccggggtatttcggttggctcgtatgataaatgtattcccttcgccaacctgaatctcagtcttctcaaaaaccgggctggatatctcatagcgagtatctcccggacaaaccggatacaaaccacatgccgccaatacataccaagcggacatctgaccgacatcctcgtttccaaccaagccttctaccttattcttatacgccttatcgcaaatgaaacgagaccatttctgggttttccacggctgtcccaaatgattatacaagaaaggcacatgatgaaccggctcgttcgcatgattgtaataagcgttccacaggaaatctgttggtgtcttgtcgaacatcgtatccagatcggcgatcacccgttccgttcctcccatcagttccaccatacccggaatatcatgaggcacaaaccacccctgttgcagctcattgcattccatacagccgtaccattccttcagcttaccctcttccggccaagcctcaaaccggccattcgcttctctcgggcggaagctatgtttctccgcatcatataaattccggtaagactgagccaacttcgcataataaaccgcatcctcctgttttcctaatgatttcgccaactgagacatacaccattccgtatacgcatactccaaggttttggagatactctgcggattcggggtatagcccaactccgcattcccgaacattctcgaggttttatccgcataccgataagccttttccatatccaagctacaaatacctttcgcataggcatccgccaagaccgatatagccggatttcctaacatacaaccgctataggcgttcaacaactcccagcgctcatagtactcacggccactctcctctgccatcgttgtcaatgacttcaacaaatcgttcaccaataccggattaataatcgtttgcaaaggcatctgactacggaacacgtcccaaccgctaaagatcgtacgtttcgtgaacgtatccgacttatgcgcttttccgtccgcgcccatatattgaccatccacatccgtgtaaatcctcggatcgatcattgtatgatacaaggaggtatagaagatcaccttctgctcatccgttccaccgctgacatccatcttagccaaagccgtatcccataacgagcgggcacgagaacgtaccgcatcaaaatcccaatccttgatctccgctttcaagttcttttccgcaccctccaagcttacaaaggaaataccagccttgaaaagaacctcctcattcgcctcagtctcaaactccgtaaagaacccgaggtgctcgccctcatatgcctttggtctctccgaaatctttgcgttcgctgtcaatatctggaaagccggactctccacgaattcccgatgccgatcctgccctgccgggatatccacgctccatacaccataatctttcaacggtttggaaaactgcgcataaaaatacacggtgtatcgggaagaaccttcaccattcccccagcctccaccttccggcgtacattccattcgtccggcgatcgtatggtcatctatcacttgaaccgcctgatacgtagaagtacctcctacacgacgggctaagtccaactggatgcgggactgcttattctcggggaaaacgaatctcagcataccgctatgaggagccgctgtcgcctccgcttgtatctggtaatcgctcagcaataccttataatatccagccttggcctcctcggaagatttatcataccgggaacgatacccggctacgcccccctcttttcctgagttcgtgcgcagatcgcccacggtaggcattaccaataaattacccagatcaccataccagccgataccactcatctgcgtaaaagcgaatccctcgatcgtctcatgctcgtagctatatccggaaccattgtcgccccccgtaatcgtattcggacttacctgtaccataccgaaaggggtagtcgcaccggggaaggtcttccccaagccatggtaagcaccggccgcctccgtattcgtactcgccccgataaagggatttacataatcagagaaatgaacctcctcgatagtccgggtcggaccggaacaggcagttcccaccaacgcaagcgataacgccgtggtcgttatccatcttaaatttcttactagtcgtatcatttttttataagttctattctacgtaccttcggttgggcgatctgatacatacgatccaccaacatatcgatttgttggctccaagcctcccggatctccggatacatcatcttggagtagttatccagatggccggccaagaagatattcgtatgaaggttcgcccttaacgtatccatagcggcgatattatcctgaaataacatgcccttccgcttcaagatataaaattccgtccacgcatattccctaaaacgtttctcgatattccaacgttcctcattcaaatgcatgacccgaacggcctgctgatattgcggtgtgttcgttaacgccgctaagttaataccttttgccaaatcctcggccgaaaacgtagaaattgaatccccgtctatctccaacctatacgaacctttcaatccatccacccgcaatacctcttgattaagatcctccataatcggagcgtacaaggtcgcctcatattgcgtatgcttcttctcccaaccccgagagatcgtatccatcggataaggtaaagacttcgctaaataggtaaaagagatcgtacccttgtctgatactttcaattcattcacgaaacaattctcgttcgccaacaccatacgtcgggaagcatcgatatcaactttggcgaccggtttacccgccaatccctgagacttcaagaagaaataggccatcaacatattaccgtggttatccggatgaatccgatctccttgcattaaggtaaaccgcggatctttcgcttgttgtaccctgttcacctctaataccgggttgtggaaatccacgaacgcccagtcattcttcacggccgcctctctttgcagacggatgattttctggatcgtagcgttctttccaagaaaaggcttatttttctcattttgccaagtctcgtcgtacggcgtgccaccgatcatgatcacccttgtatctttgtgagatttcatgatcttctgcatcgcctgaaaggtcgtatctacccgatacatttgccgctccacgaaagccgtaggattatcgccgttatattcgaaataaccactatcgttcataccgaaagtagccgtaaccaccgtcggatttttaccatatacatcctcctcgatccgttccaacatatcccaagaactgtcaccaccggtaccggcgctatacatccgcatccgcatatccgggaaatgagtgatatagtacaaccatatataagaatgataatgtccgccctctgttatgctattgcctaaaaaaacaacccggtcacccctttgaaaaggggaaggagttttctgcgcattgccacacacaaacacagaaagcatacacgccaaactaaaaagccatcgattagttctcatcttatttacttttggacacttagaagttcaattgtttatccgatacggccacagccacgaatgaatcggcacagccataatacagataccatttattccggtaatagaccagaccttccacgaatacggtacccgcagggtattgaccgcttttttcaaaatcatccgtcggttgcaagaaaggcttatccaaacgaccgatcaattttgtcgggttatttacatcgaacaatgcttgtccggcacaataagagttcgcaggataagcggtatcccctttttctcccggttcgtttttaccgttatacaacagaacgatgccatcctttgtcaagatagcgggaggtccacattcggtcaactggctatcaaaatagccggaacggggagagaacaatttaagcaactcaccattctcgtccaacagtgggtcccaatctgttaaattatcggaggtagccgcatatacattcttctccccccagtacatgaaatacttgccattcactttcgcaatgacctgcttatctccctttaaagtcgtgactaacgatgcggatttggtcgcctcatccttgaatttgccattataggctttctcaaaagccggaccgaacttcgtccagtgtttcaaatcctttgaggtcgccaccgccagacgaggcaccttgcggttccattgcgtatatagcaagacatacgtaccatcctcggtcatagcaatacgaggatcttccgtacctccgggacattcgttctctacttgattatctttagccggataaaaagcaggcttcgtatccctctcgaaatggataccgtcagtagaggtcgcatatcccaaacgggaagtccgggaaccgattccctgagcggagttatcttccgcacggtacatcaccacaatcttcccatcgtaaatcgtagccgccggattaaatgtgtcactctcctcccatgctacagaatcttcccgcatcgggcaataaaacttagttggtaacggcttaattaccggattcactcctgtcggacgctcaaacccgtccaagcaccaagctgtttccgatacagcttccgccgtctggtctttcttttgagagccgcaagctacggtaaccaatcccaataagccgaaagtagagactaataatgtttctttaatcatgttattcgtagtattaagttatatttattttccatatgaagggggagctatccgagttccccacgtcttatccggcttcccggataatttatattccaaggtcgccccccgatataaatccgaccaatcgatccaagtgccctccatcttctttccatcaagacttaaggaatggatatactcttttttctcatctccccccttgataatcacgtctccctcgggcaaatgtaaaacaatcttacggaataccggactattcacagagaaacctcccactccgggaatctctggaaacaaaccgatactggcaaagacataccatgctcccatcgatcctaaatcgtcgttgcccggcaaaccgttcacacggctactatattgttcgttcagtatacgccggatcacttgttgcgccttataaggagcccccgcccaattataaatccaagggatttggaaactaggctcgttaccggaggcgaaccattcatctccataactagcgtccaaacgtcggaacatctcatccaaacgcttctccgccgcttcctttcctcctatactatcgatcaacccttgcaaatcataaggtaccatccagaaataattcttatatgtcgattcccgccaatccgcatcataacgtttccacgagccatcctcgtttcgggactgcaaccaaccggtctccttattaaaaagattcttccagttcatcgcccgttgcgtataccaattacaaaccggctcatcattgcaggcttgcaaggcgaaacggccaatcgcaaaatcagaagatgtatattccagtaagatcgaagcgtcgtaataccctttctccaaatactgttccaagcccggtcgagtcaaaacaccttgggaattagcccccggcacttctgctccataacgcatagtccgcagtaaagttcgaggatcataggtgcgagctccaaacgcatacgcattggctacaagaatcggagtcgggtccccctgcataacacctgtctctatattcgccagtacccaacgggggaagccaccaccggattgctcggcaaataagtaatgagacataacgatatccgaggtctcctcgggagctagcatagcgatcaaagcagtctgcgtacgatacgtatcccaattactgaaagaggtatagaattttcgggctgtcttatgcacttggctatccgcccccatatattccccattcacgtcgctacaaacattcggatggattaatgaacgatatagatgcgtatagaattgcatctggcgatcctcgttatctccctctacctctatcttcccgaggtattcattccatttatcttgcgtcgcctgacggaccgcagagaagtcccaagcgggattctcaaccctcaaattctctcgggcattctccaccgagacataagaaacaccgatcttatactgcaccgcctgattcccctctttcaacggaaaagtaaaatacacccccgagtgactgccttccgcaaacgtatgattcgcatgtagtcgctcctccttccatgtaccaaaactctccgcatccgcatcgaactcagccacaaagtaaaccttatagggagttgggattccacagaaagcaccaccctccgcatatccctcgcaactatgaggacccgtaatcttaatagcggctacttggataggggtagcggctactcctcctccgataatcacggtaccctgcttttccttggaagaaaacgtataacgagccatacccgtacgttccgtaacggttaattccgcacgtatagaatgatctacggtggctgcgtaataaccggccgttccgatctccttgccgaccggagtctgcatattcaagatactatccggagaaacccgtaaagctccggcaatcggaagcgtagggaaatttcccatatgatcgcatcccgcaccactcaattgattgatgacaaagcctagttgtttcgtgaaataagtcggggtaaactgtaccataccgaagggataggtagcccccggatacaaatatccggaagcccacccattaccttgagtccctatcagggtattggtcttagaaacgagatttgacgcatttaccaaacctccacacaacaagaaaacatagctaaccacacatattcgccttaaaagctgtttacatttaaacatggtaatagatcctttttattatttagccttttatactatatacccttcaatagaataaaacacttacggcgtaataattaaaaaacagctattaacataagtcaacaaaaagggaatcatatgattcctattccgcaggcagcgatagcgtgtgttttccactttccaacaggatcgaacccgccgatatttctacattattcccatctaacacacaattcgatacgttaaatggagcgataaaggtcgccatactattcgccggtatctccagatcgagggaaagcgatcggttctccatagtccaagacacacgtgccgtaccgtaaggggtctctctcgccgccctcgcccacgtcacgccattcggtatctgaggtttgataaagaaatgtttatagcccggctcatcctcatccggcaagatccctccgaccgcctgacagaaccaagcgccaatgccattgaaacaattatgaaccttactacgttctcccgaccagtattcccaagtcgtagaagccccttgatcgatcatatatagatatcccggcagctctctctttttcagcatggaatagagaaaatcggcctctccgtcctttatcgcccaatcggtcaagattgtaacacccaccaagccggaaccgatatgccctttgcaattctccaatgtctctcgatataaaccttcctttacctcgggcatatgctgttcatctgtcacgccgaccaacatcggataaatccgatcgatctgggagcctgtagcgtactgtttcttctccggatcatagaaagtcttctggataagctcgttcaatcgttggcgacgctctttatacttagcggcatcctccgctttccccaataccttcgcgatcttctccatcgtagtgaggcaatcgcttataaagcagttactaaccagatctaccgatgactgcgccgtataatcgacacccgccggagccaaccaatcccctaaataccatgcccgataatccgtatccggccaacgtttcagcaatccatcgaccgtatacgcatccacataacgcaaccaatgtcgcataaccggataatatcgctcgatcagacggctatccccataattcaaataagtctgccacgatcccgtgataataaagccacaccaatacggaccacctcccgccgggtatggactcggtacgcaatgcggcatacccccatcctcacggatgcaatcctgccacatctgcatccagttcatatacacggaagagccctcatacaatgtctggaaactcttacaagaggcatttccatccccaccgtatcccatacgctcataatgcgggcagtctacgatataaccactgaaagctaggttcttgaaagtatatttgatcatcgcatagatagcattcaagtccggatccgagcactcgaaagacgaggcatccttataatccgtatgaatcagatagccggttacctcctcgggggctttcgccaaaccggatatccttatatattgaaacgcatggtggttaaatttatttcggaatacctctttgccttgtccggaaccgatataccaatcctcatactgtccgttctcctcttgtggcttgaaatcttcgttttcatttaaccaatccgtatattccatacggacccggtggccttccggtaattttgggaaactcagctcaacccaaccatttaacgcctttcccatatctacgagccaaatactatcccctatttgtttgattcctttgggacggataatctcttgtattcgattaggctcacacatttggggacttacctctatcccgggtacctccacctccaataccggcgtccaatccagtttgtcaagcgtagccgttgtcaaatccggcaacgccttccgcccatccacacattcacccccgaattgatggggataccaagtaccggtaccggtctcaccatacatacttccccggccttcccaagagctatctgtaacgagtaacgtacttgtagcgccatttctttgaatctcgtccaattgcagtttaaccaacggcccatcatgaacggcattaaaagtagcttttctgtaccagccacggcccaaccagagcaataagtcgtttattccctgctttgcgtacggcgtaagatcgtacgtcaccgataatgatcttttgtttaattgagataccgcaggcgagagaacatcttccgataccttcctcccatttaaatagatctcatgataccctaaggagtttacatgaaggagtaatgtggcatcacggtcttgaagctcgaacttattccttaacatcggattcttctcatccggcatccctatatatttcccttgccattccgctttatccaaaagcccgatcccaaagcgattgattggactccaatccgaggattcccccttatcgtcccatacccggactttccaataggccagcacactagatcgcaactctttccctcgataagggaccatcacggaagcggacgattccaccttacctgaattccatagatcggctttgccttgagccagcaaggaactatccgtggctacttgtatctcaaaatacgcttgccgcatagtttgcccgtctgtctcgattttccagctaaaatggggatgggtattgtcgatcgcaaccggattctccaagttctcacaacgaagatcttttaagatgaacctccgcccggattcacagcccgacatcagtaacaatagggtcacaaagtagatagatatacatttcatgataaatagattgagattacgcatgaatatactttctaatggcttacgatacttatatccccggtaaatattaagatttattaaacaagaaaggcgagccactcgcaaatgactcgccttcctacgattcctcaagaatggctagaagcggatcttgtaggattgattttcgatacggatgatataggcaccttgcggaatggttatcatcgtctcaccaattggcaaggttaaagccttatatagttgaccgccgaatgtcactagataagccgtacccgcatgagcggaccggatatgcaataccccgttcgatccccagactttcaagtcattggattcgagttcggcattgcctacggtggcgttttttatgattccggtgatagagatcgtaatgtcggacgcgatacccttgatctcgtatttaccgtcagaggtcggctcaatcaccttatcacctactttcacgataggggtagattgatcgtagtccgcttccagcgtaagagagaaagagaagctgccaccctcttccacggagtaggttccggcggaaggattcaacgaggcaccttcaacggatggaagaacgacgctgaatgtcactaccggatccggttcggaagagactgcggttactttcgatagggtggtcaaagtcgtagcgatctggtcgctcaccttacacgtgattacgcaacggtacgtacccacctcgggagcctctaccttataagaatcagccaacggctcggcagcacgtaagagagacaaggatatcgcttgaggtgctggggtctttgtcgttgtcttcttatcaatccatgtaccattctctaatctctgccattggaaaatcaccgaggtataagattcgccggggacagcggtagccatcaagtcaatggaggagccttcttccacggtcttatctccgatcggagcgatcgcgagagctcccgtgccgctaacttctgagatcaagccgacactatctgcgaatatacccgcattctcaaccgtagtattgactagcttggcttgttcatcggccgacgacaagatcagtacgccctcattcttgatctcacctaaccggttcgtgccggagagagccagttccgctttcgcctccggggtaacagtcagcgtaggagctgtcacgttcgtcaattgaatggtagcggtatctttagcggcagtctcatttgatatcatgatatcccctactatcgcgttctctattacagaatcctgttgattgatcctgagagagtctagcattacggcttccgccacgatcttcagatccgtgaggacagatggcacggacaaggtacccttggccttgtcatacgtatatccctttacgtttacctcaacactatcgggcagttcgtaaccctccagcgccagtaaggtaaggttcagcgtactatttctctggatggatttgacggtatccgccaatgagatgttcttcaagtcgtatgttatcgtataagaatccttgatactgggatcgtattcctctatgttcttgaatttaccccagaaatcattattcttatagacatccaagcagccttccgggaccaatatcttacaagtcaaggtatctacgcttttaagcgtttcgacatcaattcccggcattaacggtgacgagagttttattgtccgtaaattgacgcaattccttattgacgaacccatacctttcactgaggccggcaccgtcaacgaatccaaggaactcccgaaagaatgctgtatcttcgtcaccgcataatctattccccccacggtaaggagagaagggataatggcattacttccccctttatagttagaaagcgtagcttccgcattggccttatctaactcataggtattgactccctctttatattcctcatatccatctattgttatttgcagatcaccaaacaacgctggtacttgaatcttttgttcttggtcattaattttcagaaagtccggtctacaatactctcctgtctctatagatctacaacttacgctaaaccgaagcggcgttccatctttgcttcgaacggttacatttacgtcctctccgtattttactgattccggcccatcaaaacttacattcttagattgataagtaatcttcaaatcattggatggagctactccctcatcagactcagagatattagcctcttgtaccggaagacctgaataagccttataaaccttaccggcccccttaggaacaataattttcaagttatccttgtcaacaacatcaaacaaataacttgctataccaacaggaatatatcctttaaatgtgatggaagccagggacttcgggagcacattattaaaatacataaactccttgaccctatatttagagccaccaaacgtcacagagtccggcacaatcagattcttggttgtactcgggacatcgtttatacaggctgttttgccatcacgatcaagactgtaggcatatcctcctatcacagctttaccatatcctgtgacatgtataactacatcccctgtcacattggatatcttgtagaacttaggttccttcttatcttcctccaaatgcccctgtgaattttccatagagacactatagttcataggattcccatacgattcgtatttaggttttaacctaaaggtgaacgtctcgccatgtccaacctccgccggaccttccacaagctccatgttcttaagatcataggtgatcttgtgcatcacttttgcgttctcttgcccactggcaatccacgttccactacataagaaagccatcaccaacagtgacagtcttaaactaattttttgtaaatctagtttcataagctaatatttataatgaacaatcgttttaacattcgttcacgggtatgctcatagcttcccgtctatgaccggtgagagagcctaggccatgaaccatgagagagcctcgtctatgaggggtgagagcctaggctttatcagccctcatagatgaggctctctgccttatcagatctcgtccggactctcgctatcgcctccgcctccgatacctaccgtcaagaggatggggaacttataggtacgcgggtctttcaccaagccgtaattcgcccccgcctgcgtagtgacgctcagccagtactgcccctcggcgagttgcgggatctggataattatctcgctcttggtgttacgcacgatgagggagaccttcacgggcgtggcgccctcctcgtccttggtgaagtagatgcctacagatggatcatcccccttgataagcagtgtgctgccgaagatgatagccggagcgtttggagtgatatggaggttcttctcgttcgtggtagaatccgtgaggctctcgatcatcgggcccacggtagctacgtcggcgttcacgtagatgttttctagcgccttcaggagggtggcgctgggggtgaacattacggtgatcttattctccgtagagcggaagtctgatttctttccgtcgaacgagccgttgatagtgagcagccattgcccgaacttgttcaccacgcaacggccttgggcgagggcctcgatcatctcgtcgtaggagaggtcgaggatgttggtgatcgtctccggacgatactcggtacgtttcttcacgatgcggttcgagatgtctgaggttcgcgtggttccggtaatgcggatctttccggtgaaatcgccggttttctcggttaacacgttgtcgtacagatctacggtcaagatggtcttttcttctgccatgatgttttttgtctttaatgccccgtggtagtggggcgttaccttttaataatgtttatcacccttattcgcgaaataaggggaggagatatcgcacgtccaacataaactaaaaaaacacgcataaccactatttttaaccgcatatccacgatatatgcgcaataagcataaatttggattaattagaggatacgatatctgtatccccttcaattcctatttcttaataaatagataaaagtgattgtttatcaataatattttttacatttgccaagccttccgttgaaaatagcctattataggtaatttttatgctgaataggctcttccccttatttcgcgaataagggcatcatccagccgccaaaagcaaatccacctcttccgtcaccctagcgttcgcacgattcaattccgactgttccaaagaggccagataaaaacgtgttgttttttccgaggtatgccccagcgcttggctaatgatcgataaagggacttgtttccgcaaggcgttcgttgcccatgtatggcggaaaacatacgaggtcagatgaatggggcgagatagcgcacgaccgatcttcttcaacgagttattatacgaacgcagtatcgccttgtattcctcatgccctacctctctacccggagataaaatagggaaaaggtacggggaagaagcgtccgcatacttattaatcaaccgccgcatccccgctgttatcccgacacggattaaggtccccgtcttcttacgccgatatacgatttcctcgccatacagattcgccgtagtcaagcgagccatatccgcgaaaggcatgccgcaagataaataggcgaacgtacaatagtcgatcacgcacgccaaatccggctcctcagacttcaaggtcacgatctcccggagcgactcgtttcccaacgccctagatccggctctttcccgcttcaagttcaagtacgcgaaaggcgatacgacgcaagccggcaacagaccatcccgacaagcttggttataaatcgagcgaaagttgctgaggtatgtattcacggtattcactcgcaagccggcggattgcagataagcgacaaaacggcttattaagcccggggttatctccgggaaaaaaaggtttctcctacccagaaaggcgcagatccaattacgggtcgtcctatataaatcggcagtgttatgtttccccgctaaacgtttctcccggatgcgttcggtggcataggtataaaatgtgatgcccgccttgcccaagcggttattctttctcttgctcatatctccttttttgatgattaaacgtattattatctaccatcaaaaatagcataaaaacaagatcaagccaagtccatctcgcaaacagcaagcttccaacccttaaagaccaaggtgacaagacgaagctccgtatcccccttggtagcgtgaaccttcgggtcagcggcgtaacggcgtaactggatggcagcctcggctctcaacgcctcgatttccgtttcggaagcgtcccaacgggcgtatttcacctccacgatatagctaaagcctatctcgggctggtggatcaagtcgggcatcatgtagaaatcggcgtaccccttgttggcctcatactccggataaattatataggtacgggtcaagcctagataagccagtaggaaacctttcacgtgcgcctccccctctatgaactcgcggatagcgctctgccgctccagctcggaggaaaaatactcgaacacaggcttccagtctccgtcgtaagccatgtcctttaccagatcatgaagcttgtataactctattgagaagacatcagcttcccggtaagcctcgatcagataggtatataattgctcacgtaccgtcaggttgggaacgcccagaagggtatctccacgcttggtacccttgatggagagcaacccgaaatagtaaagcaggctcttgaagttgtccggcttggcgatatcctcggcaggaaaagcatccttgattactgcggtggtctcgccgttgttcacgatctcctggatgatcgaagcgttcgtgccgaaccgcttgtcgagacggatcaaatggcggagcttgttgtagtccgtgcggatgttgttgtcgatcatcttatccggggccgatctcaagggcaggtaattgctgatgaaatacagtaccatatccgagttgtacataggctcgtccagactcttcgtagagaaacggtagttatcgtaccacggcttcatcaagttgatcagatcgtccacactatcctcaaaacctgtctcgctcttgtaataggccagcatctcccgtacctctccctcgctaaaacctatgattccattaaagcggtaatctgtcgtcatgttggctccgatattgaaaccgctggtcacgtcgtccatcgtcactggagataccccggtgataaacatgcgcttgatagggccatcgcccgtagccccttctttcagtttgttgaagaaataacggaagaagcccgtaccgtgtgtcaatgccttgtaatgtttctcacccatattggcgaggatagcgttggtgaagttatcatactcgtcaatgaagagatagatagagagattcaagcgtttagcctcactgatcgtgtaggtcaacttctcgtcagcatttggcagactctccattttctcccggaagcccggattgaagaaacgttcgtagtagtaggcaaactcccggaaacgagcggcacagtgatcattaaaagagcggatcaactcgtcaggatctgggttcacgcctgcgaaattgaaatccagtacaagatattgtccctgctccggggtcggatgggagccgatatataagtcgccgaagagttcctcaaaagaatccttacggttcacgtcataataccatctgaggacattcaagaatagcgacttcccgaaacggcgcgggcggataaggaaaaagaaacttgcgttccgctccacctccgcaatatagcgagtcttatcaacataataataattggcggtacggattcgctcgaaatccgtcaggccatatggaatttgcttcgttgccataatatatctcctcctgtttatttgtcgcttacgaataaatcacttgttcgtaacttacttacgcaaagataacatctacaaaatgatttcacgaatctttgaccgtagaatcatgccgtcaaaccaaatcaatcgacaaactcaccagaaggaggattcgcaccttctcccactccccacttcttattagggcggtctcccataaacaattctaatgttcctcccttcatgacatcctcatgagtaaaccacgtcttattatactcggcgccattcaacttagcggattgaatgtatttattttcccacgaaaccccatgagcgatcatggtaaacactttcccgttcgccaactgaatctccgatttatcaaataaaggactacctatcgtataaacaggcactcccggagaaaccggatagaaacctaaagcggagaatacatagaaagccgacattccaccaccatcctcatcaccacaaacacccatcagatcattcctgaaccaactttccataagcatacgaatccgtttttgcgtcttccacggctgaccggcgtagttatacagataaggaatatggaaactaggctcatttcccatcacgaattgcccgacattgcccgtagcatccggatgaagagcataatattgccattttgacattttcatatcctcaacaaataactgatccaatctctcaataaaaggagtgttgcctccaaaaagatctattaaatcctgaatatgatggcgtacatcccaattataggtccaagcattattctcatcaaaataagccctagccccgatacctccggaaaaaatatagtcgaacggttctataaacttcccatctttatccttcggatggaagaaatgagtctctttgttaaagacattccggtaattataagaacgatcctgaaagaatcgataatcctcatcttttcccaaatgtttagctaattgggcgatacaccaatcgtcataggatgcggctgtagttacggctgccgcttgtcgctgttcaaatggtcctacctccgtaaactcttctttttctcccggatgcaaagcggggaaccagccattctcatgataaaaatcatccaaggccgttttaggtccccggtaccaagggatcatggactctgtcatcaccgtatgcttcataccctcgaaagccttttccacatcaaaccgcaagcctttatttaaggcatccgcaaagacacctgccgcatggttaccgttcatgcaatgcgcatccccaaatacacaagggaaagtaggtatccacccggattgctcatacatccggatataagacgccagtttttgttcttgagcctccggattcaataacacttgcaacgggtgaagggccagataggtatcccatacccaatcatccacccagaaatccaccccattatcttcatgtacctttccgtcatacgcactaaaatatttaccatcttcagaaatattgatcattctttcgtgcgcccgatacaaggcggtataaaatgtggtcttttgatcctccgtgcctccttcaatctttattttgcctaacacgtcgttccatttatcacgagcttgcgaggccaatttctccagattgaaatcattgatttcattatataaattccgcttggcctgttctactccaatataagaaattccataacggacattcaccacatcctccgattccggaaattcagcaaataccaaagaatgagagaggctatcaacttgaatgggctgggcatcaaactccaaataaaaataatgttttatcccggcgaaattatcatatccacacaaagctccatcctttatatcgatctctccttttccattggctttcaacaaaatcaaccgtcgatccgaatcctcaaaccgaaaacgatagatcgccgatttagcagcaggcgcaaaatccacccctacggagaaatcatccaaatacaccgaataattataaggcgtagatttctcatgatcatatcgatattttaaattcccaccgaactccttaacgtcccccctataaggcaacagcaacaatgaatggccttgcctatgggaaggactatttagggccagtccctccatacgatccgtcgtaaactcattatgagtcggaatcattcgcaacatgctgttaggcaggtgggtagtgggataggtaggcacaagtaaatgactgatattcccaatccggttattcacataatctactggtgttttttctattttacttatgcaactacataataatagaaacaaggttgtctgaaataatagtttcttcatgagattgtatttaataataacgattctctagcatctattcttaccacaaagatgaaaattaaagttgatgaagcaaaactatcgtgagttattcaaagcagaactctctagagaattacatgccgtgttcccgtattatgactagaaaagaggctaccttcctttttgaactgcacctcttttctatctagaataaagtttatcaaaaggatacgggttgaatatgcatagcggcaccaccatctgaagcgagcggtactgttattttatcctttgcggtaacagttaaagtatctttgataagatgattaggattggtatctgtgtctctcacatctttataaagagttactttataatctcctttaccgagggctagcatatggcagcgagtactagtgacataagggttactttgttgtatcttaaacttgtctttcggaagagcccgaaacccgcctaaatgataatcggcagctccagccaataaacgggtaaaaggaaatgatgtttagctgcctttgccaagaactcttcctaaatacgtatcatatcttgatcgccattacgtaatttttgcactattaagcgctcccgaacatccatctcatcgcaaagattaggttttaaaatgaaaattaaaactgttatttctaataatacaatcttccatccacagctttttcatttaccgctccgtttaaatgaagcttcttgtaaatttttatatgtgctctggttttctgtggaaggattcgggacaaacacgtacgactttcatccaaaacacgtacatgttttttcaaaaagtcgtacgtgttttggatgaaagatcatcgtgcttttttgactctgatttttagcattttatacactagactcatcagtggtcttattgtacggaatttgtattgagaacaaagctttccggcttaacccaaacggatgggttgccatctcatatacgtgcctgtccgccataaccactccatcgggccgtagcgcaagccggacagccaatattggctaaaggcaatctgtatggccgtaaatccaaggcagaccaatacactcaagaaaacacccaaatggctccaatccaagccaaaaccggagaagataaagacaccggtcacggactgtacgatatagtttgtcaatcccatacgcccataactaaccaatggcttcatggcattttgaacttttaccgagcggtaagcctctaagaccaacaccacccacagataagccgtcatcagattaatcaagttagttgtcgtagcactcatccaagcgttggaacaagcggatccggcctacgataaatccgaggataaacaatcccaaggtcagatagatacgaccgctggcaaactggaaattcatttttccaaccaatccgtcccaagcgttgttctcaatggtctcggctaatgtcgggactcgccggggagcctcagcacgagcgataggtgcggcagccggtctctccaccacttgctcgacggcaggagccgttacagccttatacgctacgggaattagcgaggcaccgcccaagaaaaggaaaagggtgattcccaccaataatttagtaggccatttatacatcaataccaatacaaaaccaagcaacgcatacaccaacaaaatatctacacgaaccaataaaccatgaacaaaaccaatcacaagcaacaataccaatcgccataaaaaacgaggacggaaatcaacacctttttgagctgcccgatccatctggataaaaaagctcaaaccaaacaggcaagaaaatataatgaagaacttgccgaacaccaagtaattaataaaccaccgaaaaatctcatccagcgtcccttcccaagggaacatggcttggggagccatcgtccccatagcgccaaaatgctgcatcccatgaatcaagcaaataccaatcaaggagaagccacgcagagcgtcgattaccgtaatacgtccaccggacgaagcaagtgtcttattcatttccatatccgtaataatttttattcttattcgttttttcaagtttgataacgcaaaagtaaatggtggcactaaacgccgcaatactttcaaactccaaaacgaaaacaataagcctcatcacgaaaagaactaatttacggtaagataagcaattatagtcccaacggccaaaatagcgccgattgcggtctcataaggaatcagcctcaaccgctcacgaatgcttatatccgctaccccaccagtagcgtggaagaacgatccatgcggcaaatgatcaagcacggtagcaccggaattaatcatagcggctccccagacaccactgataccggcagcgataataatatccgcgaatgacgaagaggcaactgtcgctccggctgtagtagaggctgtagcggcagacatcaatacgccggaaaccggagccaataaaatctctcccatatccgtatgcgataacgcatctaataaaacatccttgatagaggaagccttgatcactcccgctatagtgcctgtcccgaccaacaggatcgagacattcgacatcttcttgagcccatacgagagactgtccgtaatcaatgaccatttcctcatcgccagaatcccaacgattcctccaacgggcaaggctatcatcggatcgatcgccacatggaataaagggcgaaacgacagcagtaggatcgtcactaccggagcgaccatgctagaggcgaaggaggggagagccgcttgcaggttatctatctcctcgttcgcataaaatccattttgccggggtaagaaacggcctatgacatataccgtaaacaacaatccaaccaacgccgggatcaagttcgcatacatgacagagtacaaatccgcatgaaaattctcagcggcgataatcgtattcggatttggagaaatgatattgccacattttcctccaccgatcatcatcaacaaaaggctaccccggggaaccgccagtttccggccgatactcaacgcaatcggagccaccgtaataacagcaacatcaataaacactccaatagccgttagcaacatcgtagcgaaagcgagcgcaaaaaacacatgtcgttctcccaatctataaatgatcgtattggagatagaagccgccgcacctgttttcaccaatatccccgacaatacccccgccgtcaagatccgaatgacagccggagttacgtcatttactccactgatcattaaagagaccgtttccggcaacgagactccccctaataatcctcctactaatgcccctaaaataaggctatagactggcgacacctttcttataatcaagaaaatcgacactaataatccgataaaagctccccatgcactcattatacccatgtgttagtgattcatatagtaatggattacacgcaattgttgttccaaggcacgcccaatattccggcaggtgaaatccttatccatcgcctgctccaaggaaaccggataaggaagaagtggtaagaccgccagaaacccggatttattaagtgcctctacctcctctacggaaccacccattacgataaccgggatatcctgtctcacacctgcctgcaacactccgaatggggtctttcccatgcaagtctgtttatccagtttaccttctcccgtaataattagatccgccccccgtatacattcatcaaaacgcaaggcatctagaaccatccggataccgggtttaagttcagcctttaggaaagcgacaaatcctccacctaaaccacctgcggctcccgcacccggaatgtcgtctatctctattcgtcccgttctttttatgacttccgcaaaatttcgcaagccctcatccagcaaacggaccatagcatcgtccgctcccttttggcgggcaaagacatacgccgcccctttctcaccataaaaagggttattcacatcgcaggctatggtaaatgaagtttcccgcaattgcgataatgcccttgaacaatcgatctcataaatccgattaaggatctgcccacccaattccagctcattcccgtctctatcaagaaaacgaaaacccaaggcctgcaacataccggttcctccgtcattcgtcgcgcttccccctattcctattaagaaattccggcagccacgctccatagcgtcttttatcaactctccggttccatatgtcgttgttctcaagggattacgctccgacacaggcactaacgtaaggccactcgctgtcgccatctcgataaccgccgtacgattatcccccagtatcccataagtagcctcgaccggcctcatcaacggatcatgtacgacacaagatacgacttctccacccatcgccgtaatcaaagtctccacggtaccttctcccccatccccaaccgggattttcacgacctcgcaatccggaaagaccttatggatcgccaactcggcacattcagccacttcaatagaagatactgagcctttaaatgaatcggaagcaacaacgatttttttcatttaatctcctttttacacataataataaaataaatcaattccttcaagatgccccaatatatagattttaaatcaaatgaagtactacttacttgggtagagaagatatacttcattggcaaagtaagctatctcctgtgacaaaataagtatatctcctgcgacaaaaaaactaaaagtgacattttaatgcggttacccttcatagtctttcaagaatttgtctaatagtattcaaatttttatttttgcatttattataatacaattatatattatgaaacaaaaattgaacattactacattcttactgttttggtgcatcactgctttatggtctatcccacgtcccgaatatccccgtccacaatttgaacgcatggattgggtaaatttgaacggagaatggacttgctcattcgatttcggaggtaccggaatggaacgggagttctataaatcgaacggttttgaccaaaagatcacagtgcctttctgcccggaaagtaagttatccggcgtaaaatacacggatttcattcaacatttctggtatcagcgtcctatcacgatcccacaagaatggaatggaaagaatataagacttaactttggagctgtttattataaatcggaaatatacattgatggagtcttagccaatcgccattttggcggaacctcttctttcgcagtagatatcacctccttggtaacaccaggaaagacacatagcctagtcgtatatgtagaaagtgacctacgaagcgcaaaacaaccggcaggaaaacaaaacctacaatttgaatcctacgcctgtaattatacccggaccacaggtatttggcaaacggtttggatggaggctgtccatccggaaggattgcaatccgtgcagttgctgacagatatagaccaacaacaattggttgtgcgtcctcgtttctataaagaactaggaggtaaattgcaagtaaccgtaaaagacaacggtaaaatagtagccagccaaaccattacggcaagctccttatcttctgctattctacccatcaagaaaatgaaaacatggagtccggaaaacccttttctgtacgacttggaatacaaagtaatagataagaacgggaaggtagtagatgaggtaagaagctatacaggtatgcgtaaggtacatatcgaaggcaataagatttatctgaacaacaaaccttattaccaacgcttggtacttgatcaaggattttatcccgatggaatttggacggctcctagcgacgaggcgttaaagcatgacatcgaactctccatggcggccggctttaatggtgcccgcctccatcagaaagtattcgaggaacgtttctattattgggcggataagatgggctatcttacatggggggaagcttccagttggggaatggattgcaatgatacggaaaccgcccggaatttcataactgaatggaccgaaatcgtagaacgtgaccgtaaccatccttcccttcttatctggacacctacaaacgaggagttctggcctgatcgcatacaatatccgcgcctgatgcacgacctgtataacctaacgaaaatgatagacccgacgcgtcctttccacggtaccagcggtggtgtacacatcgctaccgatatctggacaatccacaattacgagcaaaatccggaagaattgaaaaagcaactgtataatgacggtaaactatttgtcaccccaaaatgggaaatacaattgatgccgaaaaatatcggtttcaacggcctgaaatatacagaccaataccaattcccgaaatataaaaaagatatgccttatttagttgatgagtttggcggtataaaatggaacccgtcacaacagatggaaagtacccaaaatacatcttggggatatggagagcccccccattctttagaagagttttacaaacgtttggagggccaagttaacgctgtcctatctctttcgaaggatatctggggatattgctatacacagttgactgatgtggaacaagagcaaaacggtatctattattatgaccgtacgccaaaattcgacatgaagcgtattcatgatatcttcagccaaaccccgaaggtagaataacatcatgatcttagtacgagggacagtcaatatgtaacaaccaaattttatcagggacatatccacatggatacgtcccttaatttttacagattacatatttatctttatctcaaaaatttaataaataaaataaataaccttgataagtatctactttcgtttggttaattttgaatagcacaacattatttatcaacagattctcctcgaactccaccaccttctcagtaatgacctacggttccgtacaatctatgctctaagttttttcatattcatttgcaattatcaccagctcaaatattttaagacaaaagggaaaaatattagctctttacttacaaaataaaaaaacacggaactcatcaatgaatcccgtattctttaattatcaacattttagaggatatgctacttttttcttgtacatcttataacttcctgattgatgtacttaactttctccagatccatcttctccacctttcggtcataagtgaccaagccgtttatctcatgttccacatctgtagtctgcgtatagatggccgtgcttagtccgaaatagtttatcatctgctctagctcggtaagcattaatacataggtatcggtcaggacctctctattcaacatcatctcataagcgtcattgcgtacaggccacatatgcccacgcacaaatagaccttttcctccgaattcgccaagggacgcagcacgtttatcatcgggacgggggatcgccttaggctcgatcttgccataatgatgcatatccacgaaatctccatttctgggatctccataagccttacgatagcccggagcgtaattatatcccgacataccgtttacccaacgattcggatcgtactttttcacccaagctgtgatgtctgtcgcttcaaaagctccccaattctcattaaacgggacccacatcacgatagaaggcgagctgacgtgttggtcgatcatcactttcaattcgtcacggaactgtttacgaaccgccacggaatcctcaccatccggctcccaaagattcggcatatcttgccaaaccatcaagccaagcctgtcacaatgataataccaacgttgaggctctactttgatatgcttgcgtattacattaaaacccgcacgtttcgccagttctatatcatacaacaaagccttgtcggtaggagcagtaaatgcgccatcgggccaataaccttgatctaaaagaccgatatggaaaacaaactccccgttcaataaaggccgaagcacaccatctacctttcccatactaacagaacgcataccaaaataagaagatacctcatctattatctcaccctttcgatctttcaactgcaatttcaaaccatacaagaaaggatcatctggactccatagacggggttcccggataggcaagtaaaaactcatattggaatttccttcggttcttgccacctctgaagtaccattatccgcgatagccgttacctttaactccttatcctccgtataagcaattacttccaaccgattattttttaaatcgggcactagcttaatctgagaaatatattgtttctctaccggttcaagccaaacggtttgccagataccggaggtaaaaatataatctccacgtgagccgttcttgcccgaagcggcccggccgtcgttaggatcataagcacctaccacaaggacattttcaccggatttcaaataatcagtaatatttaaactaaaagcatcgtaccctcccgtatgggtacccaccttcttaccgttgacaaacacagacgagatccgatctacagccccaaaattcaacaatacatgcctgcccttccatgcttgaggaacagagaagctacgcttataccacagacaagtatcacccccacgagctataccggataattccgattccggaggatacggcacacgtatcttttctactttcgcgggaaaggctggaggagtggtcgccgtaacaggatcgagcaggtcttttcctcccatataatcatcgggtaagtcaagggcattactgcccccttctcccctaagaaccgtacgtgagagtttcccctcatacggctcaagcaactcaatatttctatttgttgttagaaatcggctcatactttcaacagtttcgtttatttcgcttgtagcagttgttatggacaagttgccgtacaattgaaccaccaacagatatttcattgacgttccatgcttttgtacaatctatctccttgccgcataacggacaagtccgcttctgcttgttccataaatataagagtgacttacgtcctttgagagattccagcatttgttgctcctttcgctgaaagaaataatcatcgtattccgggtcgaaagggtttgcctcccccttgacttgcttgtacggagtataatgtatatccgacaaccttttaagggtcaggtagttcactttcttgctttttgtttcatatttccatgcaaacgtccatttacgcccccgaatttcatgccaatacttatctgcaacccaagacttgcgtttctttgggtggcgacgtaaagcccatttctttgtgaggttgtaaatgtgattgtcgcaaccgtgaaaagcattggttgatgcaccatatcggtaatagtttccccaacctgttatcacaggattgagcattcgtatcagcgattcctgcttacacattttatgtcctttaacgatgtcactgatttttgccctaaagcgtttctgtgcatctttggacggagatgtgtacagccttttgccgaacttccttacattgaaacctaagaaatcaaatccatcgtatatgttcgtaatggtagttttctcttcggataaggtaagacccctttctttgagaaattctatcaccattggtttgacctcgttttccaataattccttatctcgacccgtgattataaagtcgtccgcatacctgataagattcactttgtagtggaatgtcttatagttgatgaaacgtcttttgaatctttcagccaagagtggttgaagtccgtcaagtgccatatttgcaagtgtcggtgatatgatacctccttgtggtgtaccctcttctgtcgggaacagtttaccattgaatacagctccacatttcagccattttctgagtattgttttatccatagggatattttcaataagccagtcgtgactgatgtggtcgaagcaacccttaatatctccctccaaaatccattcgggggaatgctggcgatttagaaccgtatcaatctgacgaattgcgtccattgtcctgcgcttctttcggaagccgtaagaaaaacggccgcctgtcgtttcggctatcggttccaatgccatgagatataatgcttgcatcgccctgtctttcatggtcggtattcccaacggtcggagtttaccgttctttttcttgatgtgaaccctacggagcggctgtggatggtagccacgacgtctaagttcaccgattgctttgtacttgcgcttgggagagtcccaaagctgtttatctactccagacgtattcttccctttgttggaagtaaccctctttactgccaatgccttggcgtaaaaagagtgagtaagcatccactgcaaggttttcaccttgttatgtctgccttctttctgagcctttacaatacgcgcttgtagctttcggacataggtttcacacttagaccagttcataccgtcccaagtcagattcctgctgtcagcaggcgcacacgatgttttaatctcgttcatttgctttcctccttttgaaagttctaaaagttatcttgtaaagagttaccatatacggaagtctgcccactttcgtgtcggatgatgttaccctcattaactcgtgatgttggttcaatccgtatcctccccattacagggcggcattcgctttcttcgttatctcatacctgcaccccattcggcttgccttgcggttcgcttactcgcattattacgagagagatacaggcttgccctgttccacgcaattgacaaacggatagtttaggttctgccaagtccgccggcagtgctatgtccgtgtaaccccaacatgggcgagggttatccgactgcttaccttttggtgagagctaaagtatcttgcgctccttcaaaccttacgacggctaaagtcagttcacattacgttaaccatgctatccagcctcgccactcgacggtatgatactaaccgcccttgacgttccctcacggttcagtcttgtcctttcggaaagtgtactttgtcctataagcttagcacaacccatcactggagatgcaccttatagtaggctaccgctgacggaacagcgggttaaatcttgtaatatacattgctgtttaacaatcaattacgtgacttttcaggtcacacccatataccattcagattcaaccattccgaacgcaccatctgtggacgcggatattccggtaaaggaatctcagccttcaatgcctcctctgtccatggagtaggcaatgtgaacttctctaggatttgcgcctttacggagaagagatctcccccaaaaagaaaggagcaaagagctaaacaaacaacggtaatctttttcataaaccaactatttaaataattccggataatatttccgaatcaaatcttgatcttctttctccaacttatcgatcaagaccggcttatcttgcgggcggagacctttttggttgattttgttgatcaagctccaatccttagccggttttgtcggggtcggatcggcaggttcatgagccggcaaatcatagcgggtaaagtcgatgacgtaagccggggaatttttcgtatgccaatcacgtaataaggccaagcggaattccttattcataaaccattttatctccaaattattataagagtctcccaaaccagagccacgttctacgaagtgatagttccagtcgtcgttcgatttatattgttttctccaaagttcgccaaattctccgaacgtaacgaaatgagtatccggccagcgttccttggtacccgttacccacatcttcatggcatcacagatgagatccttcccgaactcatgtaccatctgcgcctcccagatattggcgacccagccaaagccattcaactcaagacctttatcaaagtgaatcgcttccgtgtgcatcacctcacgatgccccaagtcaagcccccaacctttgtacgtctcgatcgggccgacacctctacggctgttgtatccatcgataccatgtccggtctgtccgctacggcgggcacagataaagtccatcgtccagccatccagattcacgcaatcgatgaaatcgctttttccctgcgccggcttgcagaagtgttccgtcgagggatagaaaggataagaaggagaaccgtcagcaccaccaccgtctatattatgctggctccagatcacggcgtgcgccacatggatgttctctttctccgccaaatatctcaaattatcggccgataagaaacctcccataattgactgcggacgataaccatttcctaccattttagaaatgatctctatcgcctccgacatctcacggtttacccgctcacggggtagatacatcgcaggaaaataaccggggaaataagtaacctcatccccatatttcttttggcactccactacataatcacggatctcccggtaattcttccgtccgtcctccaaggcattcatcgtgaatccccatgtaagacgaccgttcgggttattcgtggcgaaagcctcccgcaaggcacgtactccctcaagcgtatgccaatccacctcatcgcggggatgtaacttgacatcccgggagacttcccaaggcgtcgtacgtatcatgatacataaggtgacaaaacgatttccttctatcgtcagcggttccgtattcgccgggacgaccacaggatccgccgcccttaattgaaaaccactgagcacagcgaccatccatacgatcacccattttctccaaactgatatattcatattactttctcgcatttgtacaatctattactatttcctgatccgacggaaatatcctaaagacataatccgaaccagattcaggtttccttatatggcctttctcgcaggtgatcacgtagttgaaaccatcgaagctagcgttgactgccttatcctctataacggtgaaaggtagctccttccctgccgcagcctttagctctaaagcccatgagaaatccgcctcctttgacagagcggctacctcgaagcgggtctcatagaaggtgatcttgaaagcatggccttttgagtcttcggcggaaactaccaaggtatccttgcctatctccgtcactaccggatggtccaaggaaagttcctccttatctccatccttgtctaatcggacgatccgaagcccggcacgatcgagtccctcgctccacatgaatccgtccacgaccggcaacgtatagaataggaactggttcccgtctccgggcttttccagataaaccgacttatagctctcgtcgaaaagatggatatccctaaagcggaacgttcccttctcccacaataagttcgcccgataataacggctgttaaaccagaccgtcttattgccttctccacggacatccgtcaacgtagtgacagccgtcgccggcgtaaccttgaagcattccttgaaccacgcaccggattcgcccagcgtctccacccggatcttattttccttcctcaaggagtccaagatagggatctgcatctccagtcccttgctcatattactccacgtgaaagagttctcctgtcccgcttgcgcataattgaaggccagacaaggcttgttcacgatcgattccaagaaataatccacccagcggcgatccatgcccgccttctcatacacgggttccaaggagatcaccccttgacgctcttgtcccagaccatcatcatactgataaataggatcactgcccagcatacggaaaataggaacggggatttgcccctcctcggtctgcgccggcatataagcgtttatccggcttgggtaataggcttggttccagtaaccaccccatagggtataaccatccgtccccacttggtccttgcagttgcacgacgccacgatcttatatttatcgtacatataccccaaggtatgcgcgtcgataaaccaagagccgaccgatttcgggtacgtgccgaatatctccttgaacttcgccatatagacatccaccaatcgctcccgttcttctttcgtatatccggtgctgaaagcgatattcgcgtgcgagacccaagaatgctcgccacgccacttgatcccggcggcctcgatctgcggttgcgtaagttcccaccaagcgccgatctcggaatgatcattgagtttacttttcaacagatcttggtacaatgggttgatcaacgcatcgtactgcaataagaaggttgccggtaaatcatatttattcaccaatttcacttgctcacaaaccgtctcgtacaataaactatcagcgttctccacccggtaatctgtctggcggatgaaattgatgatgttgataatacggggagcagccgcactctcaaccggtttctctcccgcgctacggcatcccgcacagcagaagacgataaagcatacaagacctatcttctttatgaatgacattcgattcaattttaaattcatttactctcataaaatattctagaaatggcatttcaccggtgtaaaatcatttttagagatctaaaaagcatttcgcaagggtgcaaagccatttcttaaacctaaaaatggcatttcacaagcgcaaagtcgtttttagaaatctaaaaggtacttcgcgagggtgaaaagccatttcttagatctaaaaaggcattttacaccagtgcaaggccatttttaccggaatataaggcattaccctaccaccccggattgttcggagccaagttcgggttcagatacaactcatccaacggaagggaataatagtaatgcttcggggtcacaaagttacgattctccgccggttccacaatcaagaaaccattttcgtctgtcaaaccgggatttccctcgttcaagacatccaagttctcgtattccgaacctttcagcttaataccttttatggcacctatcaattccgtctcagccgtcttccaacgtctcaaatcatccctgcggaagccttcgaacgctaactcgatcgtacgttcccgacggatctccgtccgcatatccaacccattacccttcacgaaagcgttggtcagaggaggcatctccacgcctttccgggaacggatcacattgatcgtcttgttcaagatgtcatcgctgatcgccccgtctttctcgtaagtggcctcagccaatatcagcaatacctccggataacggatgatgtgataatcatatacatccttgtcagaaggaacggaagtctccgccatatatttccacaacttataacccgtacgtgtctcgggacgtatggtaaattgcggcgggcaagtcaaggcgccgtcttgcggactgatatagtcggttccgggcatcaagaaggtctgtttcatacgaggatcacgattctcgtattcgctcttgatcgtggcatatccctcaaatccggaattagcgttctcaattggcaatcccgtactcttacacaaatacatatctgccagcttacgggtaggcgtccctcgccatccccaatatacagggcacgcgtcgctatggtggcggatatccgtctcgtaccgactgtcgaagataccttcttttgaattatcgcccgcattgataaacaagtagcggtagctctcctcaccagagccttcatataaagcatactcaccactatcgatcacttttgtagcggcatcgatcgcttgttgcaacaactgctgatagtccgaacggtgctggtgatacttcgcccacgtcccggcaaacaaggcaaccctcgctttcaacgccaaggcagcgccttgggttacacgtcccgcctcatccgagcttaactcactttgcaagggtagtttagcatacacctcgttgagttccgacaagatgaagtcttccacctcctgttgcttattcctagaaccatacaactccggggaatctacggtaagcaccttcgtcaagataggaatatcgttgtatttcgccatcaaccgaaaatgcgagtaagcacggaagaaacgggcctcagccacataccgctcgatctccgagggatcgccctcgtacgtctggctcttctcgataatcatattgctctgacgcaggtctatgaaagtagagtcccatagggcatccgtattcggggcgatcaacgtaccgttactcgtcgtattctcgttcaactcataggcgatatcgctatccgtatccttcgtgccgaacgtctcggtacgtgtgtagagccaattgacctctttctcgaaatcatccggggttttccagaatagctcgtccggcatattatcttttggcaacaggtctatatcttggcaacttgacaagaacaaagcggaaacaataaagcttcccaatattatccgatagtttttcatgacttttcgctttaatttttaaaatacgacatttataccaaatgaataattacgggtaaacggataggaagtaatgctaccgctgttctcctccgggtcccaaccatttggcgtgttatgtacctcaaataaatcctcgccggaaaaatacacccgcaccttctgcaaaccggccttcgaggtcaaagtctgcgggatcgtataaccgaactgcaagtttttcaaacgagcatacgcaacgttaaacttcgtgttcgtagatacataataattgtagtttcgtttatccttcaacgtgatcgccggatactgggcatccgttctttccggggtccaagtttttccataccaatactcggcggattgataccatgcctctggcatcgggcaccggctctccccttccaagaacatcgtcctacggcctactccttgtatgaaagcgctcaaatcgaatcccttccaagccatactcaagttaaagccgaaattataacgcgggttcttgtcacccaagtatttcacgtcaccggagccttctttaccatcacctaatacggatagcttcccgtctccatccaagtccttgtacatagcgtcacctacgctcaagtcacccgggatacccccttccgagaaacgagatttatacgcctccaattcttgctcattctggatgattccatcaaattcatatccgaaataggaattcaacggatatccggtcggagtctcgttattacctaatttgatcaggttacttccaacccgatccacgactttgtttttcgcgtcactgatattaaagcgaaccgagtagctgaaatccttgatctgatccctccagcctagagagatttcccatccatgaatacttaaatgtccgctgttcgtgctcggagcgtccgcacctaacatggaaggatatgtcttcgggataagcatgtttttattctctttccagaagtagtcgaacgatccatataaacggttattgagcgtcgagaaatcaaatcccacattggttgtctggatcgtctcccatgtacgagaggtagaaataatatttccagacgtagccatctgtcctttcatgccagccccgaaaggataataatcgttcgataaagagatcaattgaatataatcatacaatccgataccggactgattacccatctctccgtaagaagcccttaccttcaagtcctcgaaccaacctaaccgtttcatgaagccctcttctccgacacgccaagccgcgtttacacccgggaaccatccccagcggtgatccggatcaaagcgggaactaccatccgcacggatcgttccttcgatgacatatttattggcaaacgtataattcactctggaaaagaaagaattaatcgtccactgatttccctcgctccaagcgttttgatcttgggcgctacccaattgcaaagacatattttcttgttggtcgaagttaatacgcttcgccgtgaaccgatcatagttctcagactcatgggaagtaccgaccatcacgcttaaatcatgccggtcattgaagttctttttataatcggcatagagcgtgaagttcttggataaagttttctggtaacgacgctccgcactattcggcgtacgtttctcccgaacctcgttattatcccaatcgtaattgatgattttcttgttcgtcacgttctcatcctgatcatacttacggatcacggcttgccccaccaattgtaatccgtcgatcactttccagcgtaattggttgttgaccgttatattacctgtagtcttattcaccatacccccgtcttccaatacttgagccggattatcgaaaccctcgaatgtatagaaagttcccgacggattgtacatcggagtccaagagcgagtcttataaatcagttcccatatattttgtccttccgtcaaacccgaggaatagtccctgttgcttgcctcataagctaaattaagatcgtaagtcaagttcttgaagatctcgacgctcgatttagcacgtacgaagtaacgcttgttcacatcctcaccaaatttagggataccttcctcccgctgatggcctaaagacaacatatacgagtatctctctccaccgccggagatattgacattgtaattctgcatattaccattgccaataagcatatcattccagtcttgatccttgaagaattgcggataaccggtccaacgcccccattccgcatcgggcaataccagatcactattctgccggatcaattccaattggtctctcgtgtattccggagtgaatgatccatccgtgatctccaaggccatctccgcatgttgtaatagattcgccggtttccttaacaacgcaggagtcttaatagagtaatatgcatcaaaagcaacagatgtcttctgattgcgcttaccacttttcgttgtcaccagaataacaccatccgaggcacgagcaccgtaaatagcggccgtaccatctttcaatacggaaatattctcgatatcggaaggattgatcatattaatgtttccctccgctccatcaatcaaaacaaggggagtaccaccgttgatagaagagacatcacgaaccttcatggtcatgtccgaacccggagcgcctccggcacgtgtaatcgtcaaaccgggtacctctccctgcaaagcctgagccgcattctgaaccggacgagactcaaacgctttcgcgtcggccgtagatacggcaccacccaagttcgctctttttaccgtaccataaccgacaactacaacctcatccatttgcaaagcatcttcccgtaacttcacgttcaaattcgcttccttgccgggacgcaattccgtcatggcatatccgatgtaagagatttgaaggacaccgttttccgatacctccatcgtaaattttccatcaaggtccgtaaccgttccgttggtagtacctttctcaactacgttcgcgccaataataggttcaccattctcgtcggtcactacaccttgcactaaattcttcttttgcaaaacggcttgtgaggaaggggcggctttctcgttttttgtagagggattaatcaagatgaaattattctccgtaatctcatactttacgccttcccctgcgaaaagacgctttaaaatggtttccaccgtctgctctttcacatgtacagatactttcttattcaggttaaccttctcgctctcgtagataaaacggaagccagactgtttctctatcttgaaaagaacctcctttattgtctggttattaacgtccaaagacaactttgtctcttgcgaatagacagaggccgagatctgaagtgaacatgcgatagagaataatgtcgtcaatctcataatagacaaagtttttttaaggaccggagactcttccggccttgctatattccaaaaattcatatatttgtaattcgattgtttgttaacactagtgttacgagcactaattttaatgatcaaaaagatgacggggaatgttccagcatttcccgtttttcatgtgtattcatgcgattcctgttctttacttcataggcagactttatttagaggttatacttatattttttcctttcacgttataacttatatcactcaatcgggatagtacgcccaatatatccgttatggtttcctcctgtatgactccatcgtaatgtatactattctccaaatccttttgaagatggatggttacatcgtacctcctctccagatatttgcagacggaagccaacgacatatgatccatatagagtttatcctccagccagctgtacgaatgagataacacacccgatatcggtctcatcttgttggtttgcttatcgaaaatcgccatgtcaccggcgttcattaacaacttatcattcccatgatccaactcgatacagccttccaccaacgaggcttcaactgttttttcatccgtatacgcttgcaaattaaaagaagttccatgtacctttaagcgtaatccattgctcatcttgatcacgaacggtatcttgttcttcgagacatcgaagaagccctctccttggaaattcacttcccggatcttctccttcgcgttataggaatacgtaatatcagatccagaattcagcttaacaacggaaccatccggcaagaccacctccgatcggcttccgtaatcagcggtcattcgaaccagcatttccggctgtttatcaaatactcccattttcgaaaacccgaggacaagcaataaagtagccgccactcctgaaatgatatatccgatattcaccaagcgtttccgcttattatctctctccttattgatacgatcgatcttatcccatgcgtattgagcattaaaagtttcttgctccagataagagcctgtttctttccagatctctttataccgtttaaaatcctcttgattagactcatcctcagccaaccattcatccagaaccggatccacgatctcttcattcatcctctccgataaatggtcaacgatgtgttctcctatttgctttttcttctccatgagtctagtctttatttaaatgacaccacaaataaaaaaaggtcctatacgaaccttgaaaattttctcattattttatacctccttcatctccagacattccttcaacttctgtaaagacatccatatttgatttttaattgttttcacggatatagatagtttctccgatatttctttctgcttcaatccttttaccctgtgaagaagtaacacttctctactccgatccggcaaatggtctatacaatcataaagagcgatcctaaactcttctgtttccagttgattatcctcataggatagaagtaataagtcttgattctctgataaacttcccgtctgcacctttgatcggataaagttcaaggccagatgtttagccatccgatataaatatcctgatacattttcctttatctctattctccccctatttttccataaattcaagaaaagctcttgaacaacatcctccgcatcatttctatccatcaatagactatacacatactgacaaagacgcccgtaataacgatcaaacagtttattataactgatataatcattatttccgatcgctagcattaagaccttatcggcatgaacttcctgcatataatcttcatttatcatgaatattcacaatcgtctttacaggtaaaagagtttcggcaagactatggctaacaaaaagaagaacgaagatataaagcgaacaaattcagtttgtaaccgaagtttaaaaagatgcttagtaaagagatctgagatttcaggaaaaggagaactggattataaatatatgtggtagaataatttacagtttatcaacaaaaccatagtcttgccgagactcagttgaaatagatctcagaaggatattttacaagaaattaatcctgcctttccacaaatctcctgtgacgcaaaagtaggaaaattattatttgattgattattttatcattcttttcatataagatcatcttcccttttactccccagcaaataaaaagggaaatatctcacgacacttcccttttaccatgaatcttatgtttgaattattttacttctactacaatcatcacagggaaatgatcagatggaacacgagctacatgtttttgcatggagacctccttcggaaaattcgcattttgctcattcttcgcatctttcgcttccgaacgatatgtatccgtcaagacaccatattttttcacatcaaactctttcgtaaggaataaatgatcgatacgactgtctgttttgcgatccgcatggaaggcattaaacgtgccgttgggtacataccggaaatccgctatctgataagaatcccgcataataccggaattgtccagtaataagtaggattcattatgttgatccacattaaaatcacctgttagaatcgccggtagcttctccggaaattctttcaacttcttaaggataagttttgcgctttccgcacgggcctgtacaccaatatgatccatatgtaagttaaagaacaagaaagtaaagccggtttgtttatcccgaaatttaccccatgtgcaaatacggggaagaacggcatcccatcccttattagggcgatcggttatcgtagacaaccaaaagtccccatgatcgagcacctcgaactttcccgtacgataaaatatggcagaatattcaccagcttgcttaccatcatcacgtcctaccccgatataatcataaccgggcatcgcattctttagatcttgcaactgatgatatttaccttcttgagtcccaaagatatcaaaaccatggaactgcaccaattgggcaatgtagggataacgttgtccccagccattcccattcgtcgagtctcccgcattcgcattacgcaaattataggtggctactaccattgactccgcttgtaacgcaaatacggaacaaaggacaaataaaaaagaataaattagcttcttcataccttttatcataaaattaaatccacatcaataaattagaactctgcctctatcattatcgggaaatgatccgaagagaaatgcccatactggcactcgttcaaagtcccatatttatttacctgaatacctttagtgacgaaaatatagtcaatccggtttttcatcggggcattcaaattgaattggtttgtcgttcctaccgtcccatagggtggtgtttttgagatttcccgtgagtccaacagtaaaccatcggatttcagtatttgtataggctcagaatccggcgtaccattgaaatcacctacacagatagcaggggaatcccccgctatctttttaatattagccaacattatcaaagcagactcatgacgtgccaccttaccgatatggtcaaaatgaacgctgaagaaataaaattcctttcccgaaaccttatccttcaacttcgcccaagaacaaaccctccggcattgcgcatcccagccaaaagaaggcttatcctgtgtctccgacagccagtaatttcccgagtccaataatttaaaccgatctttcttaaataaaaccgcggcatgttccccagcctcttttccgtcatcccggcctacgccgacatacgtgtacgtatcatctttcactaattccttcacttggtgaatcaacccttcttgaatcccaaagacatcaaaatcatggaaatgaaccaaagataccgccatgtctttgcggtgtacccatgaatcatccttatccccctcattatcataccgcaggttaaaactacccacgttcagtttacacttctgttgtccggatatccctatgcagaaagtaaataaagagataaacactataattaagtttctcatgatacccccttgattaccagcccggattctggcttagattcgtattgaactgaattactacctccggtatcggatataagtactgacgagccggccagctacgtccggcgtaattatactccatcaaataacctccttgaaccggcttcacgttaagcacattactcttatttgtacccacatagacaccaatcgcagcatacttctcatcagcgatcttatccgtatcatagaaataggcatcataattaccatcgccattcacatccaacggttggttaagtgatgggataaagataccttcccaaggatcgttcacccaaagatcgcaacaattccaacgtttcaaatcatttaggcgcaaaccttccagacaaagttcaataccacgttcgcgacggatctccaacaaggaaggatcagagatcgtcgggtaataagaagcgatataaggctctgcggatgacggacgggttgtcaatgtacctgtctgtggtgtgcctcccgtaattcccgcacgagaacgaagcgcacctatcgtagccgcccaatccgcatcagtcagttcgcctaattcagccttagcctcagcatagttcaacaaaacctcagcatagcgcatgataggaatgtcattatcattcgtagccgcatcatcgtaagccacgtcatccatggcaaacttcgtaaactgatatcccgtcaatgtatgtcccgtaaaattagccgcggtcggctcataaacaccagaagcattcttacgggtataatccgctccccggatcgtctggttcaagcgggtatcacgtcctgttgtctcctccacgaaattcttatagcttccatccgcttttttctcgacataaggcgtaccatccgcattcaagtatgacagcataaatttacggctcatgcataagtgtggtccgtaagtagaggaattataccaccaattctgctcacccagtcctaacaccttgtcagtctcgatagccatcattacctccgtggtaacggccttatcggcaatgaaaagttcgcgatacgctccacggccatcgctataagcacccgaagtataaagtttgtacggtccgttatccataacttccttagccgcctcagccgctagtttatataaatctttggccgaatattccgtacatcccgtacgagcgatatccaattggtcagcggcatggtatttacgccaagcagcctcaaacaagcaaacacgagatttgaaagcggcagctgtccatttatttacgatcgttgaattatgcgtgacatcctcttccaatatattcgtatacgcataatccaaatcctccaagatatgcccgataatcacatcacgtgtatcacgcaggttataaagatccgggtcttcagcctcgttaaataccttatcaatccaaggtacctcgccatattgtaccaatttatcaaaatagaagcgagcacggaacaagcgtgcgataccattataattgtcacggatagtcgtgcttagtgactcattcacgttattctccaaaaagaaatttatattacgaagagcggaccatgaccaactcgtcgcgctattcgtagtataagcgccaacctccataccacccaaggaatttttcaccccataatctgccgtagcatcacgccggaaagcgcttcctcgggaaggcaagacattgtaaaatgagtacgtatacgtcttcaaaccattctcggagctaaacaccatatccacagaagcctccgactttggttcctcattcatctcgcaccccgaaaatacagccaaaagtgccaccagaccgcttaatagtatattctttttcatttcgtataatctcctattctttaaaatgtaacattcaggccgatgctgaacgacttcatcatcgggtaattatatccatcaccactattgctggaggtcaagtccttatccgattcaccgatattcgatacattgacatccttggaatacttgtaaagcggagaccatgtaaagagattttccccggaaaggtaaattcccacatttgtcaaatgcaattttttaatccattccgacggtaaattatagccaacctgtatgttcttcaagcgtagataggccgcattcatcaaatagcgcgtgttagcgttcttatgacctccatagaaaggcgcatagtaaccagcgtaacgaggcaagaatgcatccgggttctcaggagtccaatagtttcccacatgccaagaaggcatctggttatacgggcgattgtattgcccccagaacgtagaggcttcattagacggataccaatcctgcttacccactccttggaagaaagcactcacccagatattgttccaatcggcagaaagcgtaaagctataaatataacgaggctcctcgttaccgatgatcttacggtcgcccggatcatctaccgtattctgtccacgatcaatataaccgttgccatttaagtcttcaaacttaatatcacccggatacaacttataggttttcgatgtttgcatgagcggattataataggattgtcccgcagctttcgcggcagcctcagccgcatcgatactggcttggtcctgccacaaaccattggatacaaatccccaaatctcaccgatacgcatcccctcataataattcttgtcgagtgattgattcgcatactcgctcaatgacttattcgcattattaaacctatcgatcactgaatagtaatctgccaatgtacccttgatgctataattaaatcgcttaccagctaaatcaaatccatctctccattccaaagacaactcatagccataagtagacatatccgcataattacctttcggagaagaagcaccgaacacatccggcacggtcggaccattcacgatcatatctgttgttttacggatataataatctccacttacggtcaaacgattatcaaagaatcctaaatccgctcctatatcatacgtcgtagcggtttcccacgtcaagttgccgggaagagccgccggagatgacatataattctgccgcaaaccgtcaagaatataatcagacttgctgatacccaatgtctggatatactgataattactcaatccggccgcattgcccaaagagccccaagaaaaccggaccttagcgttagagatatgttcggacttaacattccaccaaggttcttgcgagattcgccaacccacggaagccgaggggaagaaagcccaacgctcatcactcgggaagcgggaggaaccatcgtaacgtccgtttacctccaacagataacgatcatcaaaggcataattcaaacggaagaaagcgccgccaaactgataagccttccattgtgaggtaatactccggttatcagtacccatcaccaaattcatgttgtccacgtcgtccgtcaacaagtcatcattataagcatagatgcgtttgaaagtagatttttcgtaattccatccagccatggccttgaaataatgtttctcggcaaaagtttcctcaaactctgcgaaaaggttcgttgctagatagttcgtatgatcagttgtctctgccaaattggaataggtacccgtaatatgttcgatctggctttccccatctgcatcaaccgaccgtgcatacggtgaacgtacttgtttcttggtcttctcttgcgtcttctgttgatacgtgaaatcaccattcacacgcaaacggtcacccaagaacttagcattgaatgtcgtagtattctttaagttggagttctttgtcgtaataccgctacgtccataaagcaaatcgcctacggtatagacggcagaataagtcatcgtaccatcagggttgaacagtggcgatgacgggtgtccctcgtctgcgatatttctccataccacaccagaaccttccgaataggtaatcggattgtagtatttattatgggaaaactcaaagttattgttgatcttcaaccaaggagttaactgataacctcccttgaaacgcatgttataggtcttgaacttatccgtttgctcatcgctatcgaaaagtccatcgtaactatagaaacgtcctgacaaataataatcaaacttcccgtcggaacccgagatggaaagattttgattctgcgcgaagacactcttcttatacatcagatcataatagtcggttccttccggataatacacataacggccttttgtaccgatagagccatcagagatcaccgtcccgaaatcgcccgtctcatgacggcgcttatactcatccagccaagccacggaaaattgctgtgtcttgttgataccggaaggattcgcttgattgtaattaaaataagcgtcataaaaatgctttgcccaaatataaccatcggaaactacatccggcacattctgtggtgattgtaatgaatagctagaagaccatgtcaccttcggcttaccttccgtagcgttcttcgtcgtgatcaaaaccacgccaaatggagcacgtgcgccataaatagcggaagcggcagcatccttcaatacggaaatactctcaatatcattcggatttaacatagaagggtctccttccacaccatcaatcaacaccaaagcactacccccattgatagaaccggcgccacgtacgttaaaatccgccgtacgccccggtttaccatcagacaaggaaatattcaagttcgggacaaccccttctagcatctgagtagcgttagccgtaggacacccctcgaatacatcactagtcacttgctctaccgcaccggtcaaattcacttttttctgggaaccataacccaccacgactacctcatccagcttctgcgtgtcctcatgaatagatataaccaaattatctttattgcctaccggaacatcttgagccacataaccaatataagaaacctgaagtatcgcattcggagttacctcaatagagaaatgaccatctatatccgtgatggtaccattggtagatcctttcacgaccacattcgccccgatgattggctcccctttcgggtctgtaatcgtaccggtaactttcttattaccttgttgctgaacagtttttaccgatgataaaacgatctgatgacccgatttcaatacataagccacattcgcttgctttgctatcgcatccattacagcattaatatccgcatcttccacgtcaacagagatcggagaattcagacctttgatcccatcattatagaaaaaacgatattcagtcgtttcctccaattctttaataacctcccgcatcggtctatcctttaccgacaacgatatctgggcggcaatcgcaactccggaaaagcccgacaataattgggcatacaaaagtgtccggaaaaaagagtgcttgaaattactcatttttaaaagttttttaataatacatagattttaaacaggtaactttacaagcaaatcatttacatattctatcttatttataaccggctagttatttcctttaagatattatatacaagtgattttgcttaagaggaagaagggccttgcctttcttcttttttactacaatcatctagctcatctcataggcttcttctttattaggttaacactcaacttcctatttctcatttaaataaatagtatcacctaccgacacatacgtaatcggagccgtaaggcttattatttcaaatacattatccagactattattccggatcacccccgagaaactgtagcctttaatcttattggacaaaaaacgaacttcaacattatacattcgattcaacaatactgcgatctcctccaacgactcgccagagaaggccagttcattcgtacgccaaagacgggcataagaagcatttgtcgggtgattaacagataatatatgactagacttattaaaaaccgcactctcatccggagacagaatcacaaactcttttccaaccgctgttcgtacactgccttcaaacaaggtcgtaaccacctcgtcatcttcctcatacgccttcacattaaaagctgtgcctagcgcctcgacttccatatcccccacatttaccaagaaacgacgcaatgtatctttcgaaacttcaaaataagcctcaccagataaagaaactgatctttctttcacgccataatcactcttataattaagtttagtatgcgaatttaaccatactttcgtcccatcaggaagaaccacgctagcacgttgcccattatctgccaacaccacataatccaatggatcaggtggtggaacctgtctcatattataccaatgggagccaattccaaggcctatacatattaaagccaccgccgcataagaaagccacttccataaggtatgcggtttcttctttatctccaaagttttcttctcttgtcttatccgctttttaatctcacaaaacatctgtccttgtagcttaggaggaagctttttcccggaagattcttcccatctagacttataaaaagccatgatctcttccttatgatcgggatctctaaaccacgccaaaagagttcgctcttcttccggtgaagtcttaccactcatgaagcgatccaataattcgatatgtgtatgcatttttctcatcgtgtaataagtatatcccgaaaaagaactttacccttacacggaaaaatcgagagatccgtgatttaacacaaattaatatcatacttattttccgccttcataagtaaacggtcgatgttccttttcgcatgtacggttacgaaaaggattttcaatagagtaaatgtttttcactaccaaaccgacataacctttgactgatcaaaacaatacagatgataatcatcatcccagcccaaggctattagttctttatcatcgtttgtcacgcaaatattgaatagtcttatatccgtaatcaatcgacaaatacattttccactccaatcatatacatacgtatatccgataaaactatctacccctacaaaccacaagatatttaatgcttattaactataaaaagagtgttataaggcaaagaaagccatcagaagaaagtcgatctcgcaaaaaacgcaaagccctactcaactgtgtctccacagtcttttcagagatagagaggcgttccgctatttctttataggataaatgctcatgacggctcaaacgaaatatctcccgacgggacaacggcaattcttctatcaagctattaatatattcccgtaaagactccgcatcaattcgctcttccataagcgaatcaacatctgatagctgtcgttgtaggctttccgtcagtttctcggagagtagccgattctctgtctctttataaactaagttacgggcgatggtgaatagataggcgtcaaagttttgctccacatctatcgtctcatgcttctcccaaatcttaagaaaaacgttttgggtcaagtcctctgccatagatttttcatatagtaatgagtaaataaaatgatatacatgctcattatatttccagaatagagtctcaaaagccttttcatctccattcttcagatctataagcaaatgtccatccactttcatattacatatatattacatatccacgccatacaaatcttatctcctttctgcatatttgcagttttcatatacatgagttctgatgaaactatgtcggttagtgtagatgatatgaatgataagataaagataatcagcggataactaaatagtaaaattaccgatggtagtggagaactaaagaaaaaacgaactagatggttgttatttagatatttatattataaacaagacatggtctcatcagaaccaagtacaaggttactaataaatatccaaatataaacaagcatcattacatatcgcaaatatacaaagaactcgcaaaaaaacggcaaaatttggataaataaagtaagtgtttggtattgaggagagttaagccaaattcttctatacctttccaaatcgctaaaatgcaggataatgaaaggttaagagaaagatttgctacttatccgttaccttttttagccccggataatccggcaaaataacgcttgaccacctgcggttttaccgttcaccatgcaaagaaccctatattttgcccgtaaagataaccgtttttttccgtttttcatggaaatacaggttatgttaccggcatccggggttttattctttgttccgctataattttcataactgtaaatagctatatatcaagtaattttgcaacataaaaaaaaatagagttatgaaacagacggatgtaacggttacgttctacctcaaaaagagcgaaatgaatgacgagggacattgcccggtcatggcgaaacttgttgtcggcaaattttcagaagcggcttttagtgcgaaaatgtccgtacccgctgcactgtgggcatccggacgtgccacgggtaaaagtaacgccgcgcgggaaatcaaccggcaactggacgatttgcgagcttcagccatttccatttatgccgaactgtcagccacccgtgagaatgtaacggctgaagaaataaggaatctgttgttggggacagctttcgggcaggaaaccctgttgggttatttccggacgttcatcgaacatttcgaaaaacgtgtcggcgtgaaccgggaaaagggaacagcgcaatcttaccgctatgcttgtaactgtgtggccgctttcatccaggagaaatacaagttgtcggatgttcctttcacggccctgaaccgttcattcatcgacaactatgacctctacctacgcacggagcgccgctttgccctgggaactatcgtgttgcttgtcacacggttgaacacgattgtcggggaagccatcgcggaagggattatcactgccgacccgttcgcgggttatgaagccgaacatcccgagcgggaacagaaataccttaccgccgtggagttacaacggctgatgaccacacccctgcacgacccgaaactctaccatatccgcgacctgttcctcttctcctgctacacgggtatcccttacggggacatgtgccgcctgacgacggaggatctggaagtggccgaggacggtgaggtatggatcaagaccgcccgcaagaagacgaaaatcgactatgaagtgccgttgctcgacataccgttgctcatcctcgacaagtaccgggatatggccccggaaggaaaactgctgccgatgtacagcaacaacgaactcaaccggacactgaaacgtattgccgccatttgcggaattgaacggaagctcgtctttcactgcggacgccatacctacgccaccgagatcacgctttcgcatggtgtcccgcttgaaaccgtcagtaaaatgctggggcatagccgcatttccacgacgcagatttacgccaaagtgaccgatgacaagatcgacatggatacccggtctttagaggaaaagattgccggccgcttctccgtagctatttaatctatcattgacaatcaaattcacaacgattatggaaacgaataataaagagataaaacgccgcagcacgttctccctgctgttctacatcaaccgcacgaaagtccgcaaggacggaacatgtaaattgttatgcaaggtaagcatcgacgccaagtcggccccgatcaatatcaacgcgtttgtcgatccatcgctttggaatccggaaaccaaaagggcgaacggacgaagcgagaacgcccgaacggtaaaccaggcaatagagaaactgaccgaaaaaatcaccggacattaccgtcatattcgtaaaagcctcggtttcgtgacggccgagctggtcaaaaacgccgtggaaggaatcgggcagaaaccgttcaccctccttgccttgttccgcgagcataacgaggagttccgcaagcgtatcggcgtggatcgcaaggaagaaacttatgaaagttacgagaactcctataatattttagcctccttcgtgaaaaaaaggaaggaaaaggaggatgtagcgttgcggagccttgaccgggagttctacgatgattttgaaatattcctgcgtacagatcgtgaaatgaaacccaagacagtacacgagcatctttaccggttgaaaaaaatgaccaagcgggctgtcagtcagggtacactccggcgcgacccttacgggaagctgcacccggaactgccccggcgcaagagccgccatttgaaactcgaagacctcaaaaaactgatggaaactcccgtcggtaaacccaacctccagcgggtgcgggactggtttctcttcgctaccttcacggggttgtcctacgccgacctgaaacgcttgtccgaaaaagacatcacgcagtcggacgacggaacgtactggatacacatccggcgccagaagaccgaaacgccctcggccatccgcctgctgaacgtgccgttgcagatcatcgagaaataccgccacgagcgtaaaagcgacaggattttcaacctctattgccgggggtatctcatcaagctcaccagagaactgggacggacatacggcttcgacatgacctttcacaaggcgaggcacaatttcgggacacatatcacgctctcgctgggtgtgcctatcgaaactgtcagccgcatgatgggacacaagagcatttccaccacgcagatttacgccaaagtgaccgaccgcaaggtggacgaggacatgaaacgtctgaaagaacagaccaaaggccggaaaataaatctctacgaggaggacgaaccggaaacggcagatattataacggtaaacggttgaacagtataacaaaaattgataaatttgtatgactatgacgacaagagaacctatcagcattgaaaacgggcgggtggaaatccacacgccggagaaccgtgtatggctcacgcgccaccagattgccgacctgttcggagtcttcgttcctgccgtggggagcaacatccgctccatactcaaaagcggcatactccgtgaggagcgggtttaccgccgggagcgcaaccgtgacggcggtattgtcgagctgtattcgctcgaaatgatcgccgcgctggctttccgcttaaaatccgggaatgcagaagccttccgacggtggcttgtccgaagggccacgacgaccgctgtcgtctggcagctccccggcatgaacacgatattgaactgaaaaagaagaacggccaacgttttggccgttcttcttttatatccattcctgtcccccgatacatttcttccgggaatcttccaggaatttctgtatctcggattccatgtatagtaccttgccctgaatcaaataatagggaatgatccgcgccgtacggtattcctgcaatgtacgcctgctgattttcagcagccgggacaattcctcgtcggtgacgaaccgctctcccttgagtgtccggcctccggaggattccagtttatccagtgccttgccggccttttccaaacgccggaagagatccgccacacgcggatcgtgcttgtcgatgaaataatggctcataacgcggcggtattaggatagtgcgacgattgcagcagtttcccgacatcttccggtttgtagaagattttgtgacggatgcggctgaaaggcagcaaccctttctcccggtaggtttgcagggtacgtttcgatatacccagcacgtcacagacatcctggttgtccagccattttttcaaactcacgtcctcctgcctgcggcataacgcctcggcttttctttcaatggcttccacgtgccctgccagcgcgtcgaaagccttcacgtccatacttattatttccatgttctgtttcattttttgtttcccggatgcccaaaagtacacaaatggacagtatcttgttatcagccagtggcatatggacgtatccgtcttaaaagtggcagcgagtggcgccacgtccggcggaaacgatcctccgccgatacgggatcggcacgctccgatacgccaatcgcccgtgaaaggaaatgttcgcgggcgatttatcattccatgcagggtgagccgtgaaccgactttcgcgagcgttcacggcatatcgttttctccccgtttctctcccataaccttttcctctctttttttcatgccgcggagcgcggtatggaaatctgttgtcagtagcaaaggtagttacggggctcacgctgctgcaagatcgggccgcggggcggtttgccgcaaaatcttcctctttccctgcgggcgagcgtattttccgacaaaatcttgcagcagctatcccctacaccttttgatgctaccgaaacagattccatccataccggctccgctacggcataaaaaaaaagtcaaaggttatgagaaacgaagagaaaaataaatggaaacagaaatcctccaaccttccacttggcataaaggcaaaggtcgggttggcggtaaaggtcggggcggtggctttgggcttccacgtgtggggtatcgactttatttgggtcgttttgggcttcacgttctgttatgacatcctgcggggcattttctcctgccttgtttctctcgtggctctaaccggctttttctatttcctattcactcacatcttctaaattattacaggtatgacaaagtacatttcattattcggagcgactaccacggacacgcaggtgcaggtagtcaagaaaaaccaggtaatcatcggtatcggtgcgggtgcgagcagaaagcgttacgtcgtttacaaggtggaacacaccgcccgtggctacgtgtaccacatggtcaataccgaaacaaaggaaatcagccaaacggacattctgcgacccctctcgcaaacattcggtatcggcaggtactacgacgacgtgaaccccgagttcatggacgctttcgaggtggctttgctcgtggggcaggcggaagagcaagccacggcgcaggccatcgccgccgccaaagagaaagccgagcatgaccgcatagcggaaataggggcgcagaggttacgccgcatcatgcccgaaggggtgcagggcgtaatcatcgccgaactcaacgaaacggaatacactgacccctcttacgagtgttcgaccacccgaagcgtgcgtaccgtcattctcggcttttcggccacctcccgcaacgacttcggggagttgagaaaggcggcggccaatttcccgcaaacggcgcacctctccgaatacgaccccaagaacgaacaccgctatcccgttttcacgctcggcaaaagtccgaaatacgggtggagtgtctgcaaactgacccactacacccgtgaagggtacatcgacaggctggcatatatcgcaggaaacgaggagaatatatgtctgcccgagccgaaagacgaaaaacgggcggaacgcactgaaacgagcgtgcaaggcgggtttatcatcgtggactattccgagaaggcgatagccgtattcggggacaccaagcccgtcaaggacgcccttcacgcactcgggggacgcttcaacgcacggctgacgcatgacgggcagaagagagcgggatggattttccaaaagaccaaagaggacgaggtgcggcggcttctcggaaaggacgaataaatgttgaacacggggcggctcgccgccccacaataccaaaaaatcatggcacaaggaacagattatttcaaactgacgatacagaactatctcgacgcacgggcacgggaggacgaacttttcgcaccccgatacgccaacccgaaaaagaacattgacgattgctgcactttcatcatcaaccaagtacggcagagcggttgcaacgggtttgccgacgaggaaatatactctatggcactccactattacgacgaggaggacatcgacatcggcaaacccgtcagttgcaaggtagtggtcaatcacaccgttgaactgaccgaggaggaaaaagccgaggcacggcggaacgccatacggaaggccgagagcgaagcctacgccaagttggcgaaagccaagtccaaacccaagaaaatcgaagataacaaactaatgcccagtctattttagttatgaaaccgagaacaaaattccaacagagcgttgtggcggcaagcaaacacctgccgccgcttacccccgcacaaatcgaatgggggtacaagaactgcatcgagcatatcggacgccgcacgccgaaaggacttatcacctgcaccgagtgcggccacacgtggcagagcgaaaacggagaactcacggacaatctgttagggtgcgagtgtccgcactgccacaccacgctgaaagtggaaaccaccctgcgccgcaagttcaacgattacgagtatttgtgcatcgtaacccgctgcaagggttttcaagtcctgcgcttcgtctatatcgagtgttgggcgaaagtgggacagacacccgtttacacccatatcgaagccgtacagcggtggattgcccccgacggacgctccgcaaccttcgcacggctgcgcccgatgggcttcttcgttcacgggtggagttggtcgagcgcattggaactgcgggcggagaacgacgggaaatacaacatcacgcccacacgcatctatccccggcaacggcttatccccgaactgcgccgaagcggttacggcaaacaactccccgatgtaacccctttcgaccttatccacctgctgctctcggagaacaaggccgaaacgctgcttaaagcgggacaaacggcactcgtgcgatttttcgcccgttcctcccgcaatatcgccgactattggccggccatccgtatcgccatccgtaacgggtacgctatcgggaaaccgacggaatggtgcgactacatcgacctgctgcgatttttcgggaaagacctgcataacgcccatttcgtgtgtcccgcagacctgcccgcagcgcatgacctctacatggctaaaaaacggcggcacatgcaaatggaacggcggcaggaggaacggcgcaaggcgttggaacaggaagcctcgtttgtcaaagccaaaggacggtttttcggagtggagttttccgacggggaaatctgcatcaaggtattggacagcgttgaagccatacggcaggagggcgaggccatgcaccattgcgtgtttaccaacgaatactatctgaaagccgactcgctcatactctcggccacaatcgacggcaaacgtatcgaaacgatagaggtgtccctaaaacgcatggaggtcgtgcagagccgtggcgtgtgtaacaagaataccccataccacgggcaaatactgaaactgatgaaggggaacatgtcccttatacggaaacgaatgacagcataaaaatcggggcggcgaaagccgcccgcaaaaacaaaatagaatgaaccaaatagcatataaattcgtgtcgtgggacgttcccgcactcgaaagccttgcaggctcaaaagcgtacatattacgcaaacggctcaatgatgggggaacgctcacccgtgaggagaaagactggattacccgtgaggtaaaccataacacctatttcaaggactccattctgcttttagggtatcgtttcaactttgtcgatgtactgaaaacattcgtggtaaagcagtacgggcattacacggaatataagggcgtggacaagacgagcatacgctccatgttgtacggcagagtggaaaggattgtcgaattataaaatcggggcggcgaaagccgccctacaaaaaaacataacaatgaaaatcatctataaaagctacatggcacgcccgctcaaacccttcggggagtgggattgggaagttcgggaagcagtcaagacggcccttgcactcgtcgaggggaaaaacgggttcaaaacccattccgagatatggagaaggtgcaacctcgtcattaccgtgggacacaacatctacaccacgagtatcgagatacgaccacccgagcaggacgtgatacgccgcaggagcaactggcataacggctacgcctactactgcaacggcgtgttctgggcgaacatgagcagggttaaagtggaacttgtctgattaaaaaatttcggggcggcaaaagccgcccgtaaaaagcgagaatatgaaaacgaatgaagtaaacaaggaaatctcctatgaaacgctgctcgtaaccttcggcgagggtatcgggcggctcgacaccatgttcgacgacccgcaggtgtggggcgttgccacgctgaagcagtggatcgacgggtatgaaactacgcgcttcaccgaaatcgacgaccgaacggcggttatcacatccgaatacaacatggacagcataaaggaatggctgcaaaagaacacaccgattatcaacctggaaaaacgataaaatcatgcgcaagtacaaattattcatcggctaccggctgctgggagagttttccggtatatgggaagccaaaaatttcgccgctgaaagcggcatgagcggaattttctcgctcgtgggagaaaattaccgggacagttggtacgaacccaaaaaacaagaaaagaatggaaacaaagattaaagacatcacgggagcggaaataaccgttaccgacttaaaagaggcggtacgccaatgccgggagtgcctcgcaagtccctacctgatgccctcggggcataccgtgggggaaaaccatgcctacatgttgcggcaactgctcgccctgcaaaggcggaaacgggaacacggcaggcaacggccgtgaaaatacgacgcgaaaaaaatcggacgacaaccgtccgatttttttgtttcccgtcaatcgaccgccgtatggtcgcccagcttcccgtgcagttcacgcccgatatgtccggcaatgccacggggagaaatttcagagattgaaccccacccgccatgcgtgtatatgcacgtcttgagcggttcggtacgggaaaggtagaacagatagccgttgcggagcaggatgcccacgaacaccgagccgacctcgatgtcggcgatctcgtcaaaacgtatcttcccgtcattgtataatactgccgtgccatccgcatcgggaatgacgaacagatcgtcttccatgacaatcccgtgcaactcgattagcgaccccaggcattcactcgccgatacccggtcgtaatcaccctttacctcatttgtcgatttcgtttccatatcgcttttctttaggttcagacaaataccatacgaaaaaggcgtgagaatacgttaaataccggcattgaggtacagccaagcacccatccactcgatagataatttctccccacgccgctatcgcatacgcttgacgcatatagacacgacgatgaagaagagaactacccattattttgcgagcggattaaaatttggctgttttcaatgccccaccataatgtgttccttccgtatgtaaatcgcccggcggcacgccgccggaggattcgattgcaaatataacgatttcattcgggtatcggcgacaacacgtgcgatttttaacaaccttcctgccaaagaactacccgccgtcctacaatttcggcccccgggcgggtttgcggggcgcgaccttcggctgcgccttcttctccctgggcggttcgacgatccgcagtttgagtttctccgtcttacggtcgtaacgcacctcgcagcagtcaatctcacccgcaaccgacgtccacacgttgttcacacgcaccgcgccgcccgagtagagggtcttgtattgttcgtattcgagcggctgccgcaatttcgcgtccacctgacggtggaacgagtagatattacgtccctttgctatttcgtcgggaacgtaaacccgcaactcgggatgggcggcctcggcatagaggcacagatccgccgtgcgaagctccctcggaacccactggatcatcctcgggtcgccccgcacggccgtatcggccacgagcggcgtgatggccctctggggaatgtcgtacagcacccccgcatccttgcgaacggcctccaacgccacctcctccgttacaagccggcggttcaggtgcaggacactcatcaaccggtgtatctgctgcgggtcgtcctgctcgcggaacacctgcaagaccagggcggggtcgctcaacgcgctgataaccgagaaatcggttttgtccttcccgtaggtacgctcgaaagcctcccggctcatctccggcgtccgggcttcgcgggggacgcctttcaggttttgcgggttctcccgcaccaggctcatgtatagatccgggcttttcatgctctcgggcaggtgggcgatggcatagggactgcgccgtatggcctccatgcacaactccggcgttttccacttctcggggacatattgcaggtagctcccgtcgtgccagacggcccggcggcacatctcctcgttcttggcgtggtcgggaaggttgtagaacagctccggctccagggcgaaaatttcccgggccaccctcggcgtgaggaaccaggggttcatgttctccaaaaaatcgaaggtcttatcgtaattcgtgcaatagaaccccaacactttcaggtgtatctcctcgaaggggatatagcggaggacacgcaggtcgtcggtacgggccaacgcccggttgcagacctccggcgtgagctgttcggggttgaaaaagcggatggccaggggatcgcgctccagcgccatcccgcacagacggtcggttttcagatgtttcggaacgtactccagtgccaggtagttcgaggacacggcggcctcgcagacccgttccgtgcgtaattcctccggcacttcatggagcaggatgccgtccccgctgacggcacgcaggcagactgcctccgtgcgcagttccaccggcacgagcgaaaggcaggacgcgtccatccccacgccgtgaagggccagttccccggtcatgacctccggggcaatggaggcgaaaatctcgaacttgtccacgaacgacatcccgaattttttcagcccttccaggcatatatcgggatacggaatgtaagggagtatcttgtaatcggcactgtccaccgctttcaacgccgcacggcatatttgcggcgtcctcaattccccggggacggcctccagcaccagaccgttgcgcttcacggccgtcatgcacagttcgggggtcttcaacccctccggaacgtaatacagcgcgtagctgttgctatcgacggcggcacggcacattttcggtgtcttcagacggtcagggacgaatttcagtgtttcgccccggtggccggccgcggcaagacaaagttccggcgttttcatcgcttcgggaacgaactcgatgttgaaagccgatttcttgatggcgaaacggcagacttccgccgttttccgatcctcgggcagcgtctcgaaaaggttctcgcgccacgggttctcgtacacccccgtatcgagataggctatatctattctctcttgctctgtcatggttttcagtatttatggaaagcgcccgggtgacgggcgcttctcttggttagacatattacgttatcgttccgtttcctccgtcccgttctcgctctggaacgtgaaggaggtcttcacgacctgacccgtgttgtcctcgacatagacgtcgatggtctgctggtcatcgctgcgcgatgtgtaatagaggcggaacacctcacggtcgagcggatagcggtcgttgggcaggaacaccgtaccgtcgtccatcctcaactcaccgcgcccgtcgggctggaaatagcggatcgtgtaacgcgcgccgtcatatctcccctcccgcacgagcgtgcagcggatttcagcggtttcaccaacggagattcgcttctgaacgggcatcgtttccagagagaacgtgtacgcctgctgtatatccagcccgttgtcgcaggatgcgcataaaagacccagggcggcgatccagaccgccagggccaatatctttttcatctttttcatgtcgcttgcaagtttaatggattatgaatttcacgcccaggccgaactgcgcgtggaaatgtcccgttgtagtgccccataggatacgctcacgccccgtcagcgagaggataatcctgtcggtcaggtacgcatcgacctccagcgtgacggccccgccatagaggaaacggtcgcggtggcggagcgtagagccgtcatagagccgcctctcgccccggttcacgctctcgtaaccggccagcgccgagccgccgaggtagaagaaaaaagtcctggacgggtcggcgaggaacttgtaatagtaacctccctcggccgtgaactgcgccaccgggatacgttccgacttgtaggggtaataacggttcaggaactccgcgccgaacacccacttgtcggcattcttcgcgtagcggctcatggccagcccgaaccagtagcccgtttcgctgcggctgtcccgggtatagaagccgtcggccatgcctccccgtatttccagcccgcgcatggcgggcagggcacgctgggcgtgcgccccgtccgaaaggaggaggcataaccccagcgtgagaatgaatatcgcccgtttcatatcactttacctttaactcgttgataacacgtgcgcgcaccaggtcggcattctccaccgtgaaagtctggtgtcgcccgccttgctgctcgtgcagttccacgaccagctgcttgtcgtcggccagcgtgaacttcgggagcgtgaagaccatgcgctcggtacgcttgccgccgatgacctgcacgttgttgtacgcacgcacgggccatacgacctgctcctggatggccgtgcgtttggccaccttcttgtccgtaatcttgaacgtcaggtagtccacgttgaaaggcacgttggaggagtttttcagttggaggtggaaataaagcaggtcgttatgcacgtagatacctttgaggaggtattgtaccccgaaacgcttgcaaccgatatgcttgatctcgcggcggtcattcttgtaaatggactgcatgatcagtttgaccagcagcggagattcgcatcccaactcctgcaaatagatgtccagcgcgttattggggcggtttaccgcctccccgtcatgcaggaagtccgccatctcgaccgacagtttcaccggctcgtcggcatacttgacattgaagctgtaataggccccgtcctcggtaatgaccgaaaggttgctctcgcgcgagaaatcacgcagggccgcctttacacgcagcacgttttccgtgccgtcggctttcgccgccagaagatccgaagaccccagatcgacgtaacggatggccgaggggaaaatcacatgaacggtcttgctgaacgtcacctccagcgcgtagggcgggataacccggttgaaggtcagcggacgggtaagaccgtcgtacaaatcgcccgtggagggcttttcctgcgcgtgggcagcgaacatgcacccgataaaagcgagtgccagaagaatctttttcatactcgataaatttttgattgttgataaaaatggattttttcagtggtgtacggaagtacgtcgtttgtacccttattgaaggggcgggagcagcaggacgctgtaaccggccttgagcgtgaccttgaccgagcgcatcttcttgctcacgtattgcgacacgccctggatggcgctgcgccccaggtcggagagcagttgcgaaccggcatcgtccgtgatcgtgatactgctgcccatgcccgcgcccatattggcggcgatctccttcacggcattgagttcttccgaccccggcacgggaataccctcgttgccgttcgtgtcatagaccgacagatcgaccggaacgaccgccccgccgtgctggacagcgctgaccttgaccgtcagccgttcaccgttgatcctcgccgcccccgttacgggcgtacccgaggggatgagcagatctcccgccatcatcggttccagcagccggaaagtaacctccccgccatcggtgagcgtcacggtttgctgcacggcggcacggatactgttgcgctcgggctcgcgaaggtcgctccccaccgtgttgaaaccccagttccggggcttgacgaactcacgggcgaagaccgaatcgggcagcggggcggcaagcagcgacacgatgttacggcgcacctggcgcacgggctgcacggaagccttgccggaaacggaggctttctgacgcggggcttcaggggcctgaccgccgttcatgtagcgggcggcgatctcgtaggacttctccagcagcgccacctgctcctcctgggccgttttctgcgcctgctgttcttccaggcggcgttccagttcctcgatgcgggcctgcatctcgcgctcttcccccgtttcaccggcggtctcctcgtagaaactgcctaactggcggttgatgtcggcataggcggcacgggaagtccggaaagctcccgacgaaccgccggcagggccggaagacttatccggcacggcagcgggcatgacgggctcttcctcctcgtcctccatcccgaacgcgaaatcctgcaaggagcgcatcttttcccgctccctgcgccgcatctcctcctgcacgtaggcatcacgcttgtccgagaggataccctccgattccggggtcggcagctccgtgttgaaacccgccgaaggctcctcccgttctttttcgccgggggagaagatcagccacatgcacccggcaaaggccaggaaaaagagcgggaagaccaccatcttcttccgcatctgtatctgccggggcgtgagttcctttttccccgcctccggctgtttattctgtttttcgttcgtcgtcataattgaaatcttttagatgttttacactgtcggcctcctgccgttgtcttaattccagctccagccgctcgatatgccgtatctgcatccgttccccggctcccttgccgaagcggtagatggaagacacggtaaagtagagcgacaagacggaaaagaacaagagcagcgtgaggatcacgataatccgcttatcgggcgagagcgccccgcaagcgcggcgcaggtggtcttcgacccactccccgaaagcctttattctcttctttgccatagccttatctttttaatgtacgtaaatcgcggttctccagaatctcgaatttctccatgatgaaaccctgcgggttattgtccgaacgccccgagttgatcagctcgcagcgcgtgaccagcgaacgctcggtgatgttgctctcgcggacaatcatttgccgggcataggtcatggcccggtagggataggcgttgaagtcgcacaccacggagtccacctcgatacgctggctgatgttccccgacaccacacggttgtagtaacctttctcctgcatgtcctggtaataggcgaaggcgctcttatcgaccaggaacagcgcgcggttgatgttgctctcgatggccgcacggtcgggcgagagggtgaagaacaactcgtgaaaacgccggatatgttcgcgcgcctccacggggcggttctggctcaaatcctgcgagagcgccagcatcagcgacttgcccccgtccaggacgtagatcttctcgcgctgcttttcggcgaaacggaagctcgcgaccacgctgaacacggataccagcgcgcacaggcagaggaacacgataccgaaaagccgaatctgcctgaaacttgtttcgatgttttttaatgacttgaattccattgtccaaattgttatgaatgattattgttaccttgtgttgccaggttgcgcccgttgggggcactgcccgaagccgggccaccgccgcgacgcccgaacgtgcggccgatcatgttgccggcgataccgccagcgacacccgtggcgaatgccccggccttgttgataccgcccatagccccgccggctccgcccgactggatcacccactcggcaacggtggggatcgtgaaatagcctatgatacctataatcaaaaagataatatagacaccgctgccgctgtcgggaatgtaattggggtcttgcagggccaggacgtccgcctggagcatcaacgtctggatcttggccagcaccgcggagaacaggtcggcgatgggaagccaaaggtacacgctgatatagcgggaaatccagctcgcgagcgtcgagtggaagccgtcgtaaatggagagggcgaacgacaagggccccagaatcgacagcacgactaaaaagaatgtccgcagcgtgtcgatggtaagccccgcggcgttgaacaacaactcgaagaagtcccggacaagctgccggaaaccggccttgatgtcgtaccacgtgcgttcggcccacatgctgataatctcgcccaagtccgtgatacccatatccgcaagccgttgttcatacacctcgtcgtccactaaccaagccttgccctcgcgcctgcgggcctcggcttccaaatcgtccttctgttgctggtatgcctgcaaatccaatgtctgcccctccagtatggcgtgcgtgccctgcaccacgggcgacatcacggcgttgatcgtccccagaaccacggtgggaaagaacatcacgcacaagccgatggcgaaaggccgcaggagcgggaacacgtcgataggctccgcgctggccagtgccttccatacccggtaagccacgtaaaagagcgcacccaggccggcgatacctttcgccaccccgatcatgtcgccgcatagcggcatcatctcctgatacaggttccggagaacctggtgtaaattgtcgaaatccatgactgcctccgttttcaggttaccaatatctgtcgttcgggttcccgtaaagtgccagcacccggtgcgcgtcgcccttttcgcggctgcggatgaaggacacggagatggtcttgcgcgtgtaatagcgcgtgaggttgcggtactccagcatcttcgtgtaaacctgatccaccacgtccatccgctccttgtccgagagcgagaggccgttgccgccggttatgaccgtcttgagttccgccaccagcgcaccgccctcctccagcaatcgggcgtaacccgccgagatcgccgccagctcgtccaccgtgaagttcgggtctgaaaccatacggttgaatcccgaggtgtagatttccgtgatctcgctgaccatttcgagcgtcagcttcaccttccgggcatccttgatgatgttatgcaccgatttgagggcgtcgtagtaagccttgctctggttataaatcttgatactctcttgcagcgacttgaccatgttggtcgccgtggtcgagctttgaaccgcgctcttgatgttctgaacgaggttcgacgggtcgatgaccgtccactgcgcttttgcctggtacgtgaagcaaagaagccccacgaacagcgttaaaatcaatcgtttcatccttttcattatttaattcgtgaatacttgggcggtcattccgacgcccgataataatccccgtaggcggagagctggagcacctcgcgccccgcatcgtaggccagggcgacatacccgtagaggtcgaagtaacggatacctccccaatacttcctcacgggacgggagaagcgtgtcccgtccttgtaggacacctccacgtaaaaaccgccgccccggcgtcccgggttgcggtagatgcgaacccggggagaacccgagcggctttcccactcgcccgccacctcgtacagcgcgaagtccaaacgcgccgccgtggggtctgatccgatacacttgcgatacatggcctgccctccctttaacgtttgccctcggcgagctgcctgatcgccagttccatatcaccgcccagctccccggcaagccgctgtacctccactttctccgtttcctcggtcgtgtaggccaggtactccgggacgctgacctccgtggcatagaccgccgactgaacgccgcccagaccgatccagacctccttgtatttacgggaagggtcgttggactggttgatcgagagaatctgcgccttctccttgtcggtcagtcccaacaaggactgaatcgcgtcgaaacggttcatgaacttgcgctggtcgagcaggatcttgcagtccgagttgttgatgatcgcctccttgaccaccgggctggaaatgatgtcctcgacctcctgcgtcacaacgatggcctcaccgtagtatttgcggacggttttatacatataacgcagatattcagccatattggccgtagagagcgccttccaggcctcctcgacgatgagctgtttgcgtacccccttgagccgtctcatcttgtttatgaaagcctccatgatgataatggtgaccacgggaaaaagctccttgttttccttgatggaatccacctcgaagaccacgaagcgcttcgagagcaggtcgatgttggcccgggagttcagaaggaagtcgtagcgtccgcccttataatactgccgcagggtgatgagcatgttgtcgatgttgaaatcctcgcggctgacccggatctcccgctcctccagctcgcggcggtagtcgtcccgcaggtactcgtagaaactgtcaaaacacggcacgatattccggtcggcgcggatacgctcgatataggcgttcacggcactgcccagctcgccgctctcggtcttcgtgatcttgtcgtcctcggttttccagagtgtcagcagcagcgtcttgatgctgtccttcttctccacgtcgaaatagtagtcgtcggtgtagaacgggttgaaactgatgggatgttcctcggtataggtaaaatacacgccgtcctcacctttggtcttacgccggatcagctcgcaaagaccctggtagctgttaccggtatccaccagcacgacatgcgtgccctgctcccagtattggcggactaaatgattcataaagaatgacttgcctgaccccgagccgcctaacacgaatttattccggttggtaatgatcccttttttcatcggttcgtccgagatgtccaggtgcaggggcctgccgcttatgcggtcgcacagcttgatgccgaaaggactggacgaggatttatagttggtttcctccgtgaagaaacagaccgcgggctcgatgaacgtgtagaacgattcctcggcggggaaatcccccgcattgcccggcatacccgcccagtagagcgtggcggcatccacggtgttgtggcgcgggcggcactccatcagagcgagctggctgcccacatcattgcggatatgccggagctcctgcacgtcgtccgaccaggccagcacgttgaaatgggcccggacggattgaagaccgaacgagtgcgcctcgttgagatactggtcgatccactccttgtttatctggttcccgcgggagtagcgggaaagggactgcatgttacgcgcacgtttctcgaacatacgcaggttttcgtcgctgtcttccaggaacacgtactggttgtaaaggtggtcgcaggaaagcagaagccccacgggggccgcgaacgagagcaggcagtccgaacggtcggtggaaagacgctcgtaacgggtgtccgtacccacgcgccccggcaggtcttccgtgtccgagagcgtgtgcaggcacacccgtttgttgcccacgcgcagaacctcggcccccagctcgatgtcctgaagagaagtcgtctccgagagcgagagggaaaagtaccgctccagcaggcccggacaatccgccgtacccgtgatctcgtcccccgtgaggcggacaagggccaagaaacccgaatcgttcagaatacgctcgaactgttccgccgcctccaggaattttgtcgccgattcccggtttacctctttgggaatgatgttgccccggcagagggtcgagaagtctgaacgcatgtgcatacgctccctcgtcgttttcgtcaggtagaggaagcaggcgtgggtcaggaacggacgctcgttgaaatgccgctcgtaactgcgggagaggaaactcatgtccccctcgcccgtggccgggcggtaacgctcgcggatgaaccagtcctgcttgtgtaccacgctgtattcgggcaagaccttcagggccttgcaccaggcggcgtggatcgcctcgtactcggcggacgtgacggtgaacagctccgggagttcgacccgatagacgaccgttatgtccgcgtccttgctgatgatacaaccgccttccacggccaggagcgggaacttgctttccagcgtggtggctttcaagaggtttctcatacgcggcccccctttcttttcagcaaccggcgcagggacttgcggttgagcaggtagcggggatgccggcgcgcggcgagcagcttcatcagcccgtgttccccgtaacgggtgttcaggcggaaggtaagccagaccagcaccgaagccgccgcaacgccgaaagcgatacatacccactgatcgacccctgccatgtagaggatgacgaacaccacgaagacggccagcaggccgcccgcgaagatgaagaggtactgcgccttcaggccccggaactccacgctcttgccgattcccttgttgattccatattccataattatttgcatgacaggttggactacaagaagaaagagcgtaggatcgtcgcggcgacaatcaggaaaatacacgcgccgaaccagctcgcggcggtcttcgacgtgtcggggtcgccgctcgaaaacttgttatagaccttgatgcccccgataaggccgaccacagcccccacagcgtacacgagtttcgtgccggggtcgaagtagctggttaccatgttggtagcctccgtaatgccggcgatgccgttgccctgcgcgaaagcggaggagatggcggcaaagagaaatgccgccggaagaagaatcttgttctttctcataactcgataatgtttgaattgtggcgcggggatggataggccccgcaccgggttaaacttcttgattcgttttttttcagtggttcgaggatagcctcacgcgctacccgtagtctttttctttcatcgtgatgtcattatggggttaaacaaactcacggacgtcgaaacccgtgggaaccgaaccctgcggagatgggctttccgcagacctctcggacatacgccggtgaaaagccgagaggtaggtgtcgatcagggattttaccctgtcgttcccgtcggggcagcccgaaacgatgacctcgaacatgtcggtctgtttcaggcccaggaggacacgtcccgtttcctccctttgctcgtctgttgaaggtggatcgtgtaccacgtggcggtaggcttcgcccatctgttcaaaactaaccccctgggcaagcgagcggcccaaaaggggcagctcttcggtgtcgtcttcatcctcgtcataatccggctcctccgcgtccgcatccgggaaagattcatcgtacagcggaaagtcgatttccagaggttcgttaggctccccctcgggagcgacaccgaacacttcatccaggtcttccggcggaatctgccgggggtgttcgggtacattcgtgggcacaaatatatcggctttttccgtaactttttcagtttcagattctacggcagcttgtggccgggagtggcgcaagtcgaggacaaagcggctcctgccgatgatctcctgccggcagggcgtgtcttcggcaacgatcccgtctgccggttcgttacgttccatccgccgcaggcggaaaaacgcccacaaggcataccccacggcaaagaggggcagcagccacaacgccccgttcatcgctcctccgctttgggttgccgggaggccacggcctcacgctcctcgaaaagccgctcgatggtttcccggttatcgtccaggtgcgccttgagaaccttgtccacgtaggccgtgatcgtcacgtcgccacgaccgatgacacgggtgatctcgcggatacgctcgtgatacgacggacgtatcttcacgtgcttgttaccggcgaaaggcagccgcagcaggcagatgtaacgggccaggtactcggcctcgggggtggggacagtccccacggcgacctcccccgaagggccgtcggggacgataagggttttcatcctgcgccggtagcggcacacgcggaagatgaagggcacggcgacgcaaaggacggccgccaggataacagataaaataattgctttgtctgacatgatggattgtttttaatgggttgtaaatattgggttcataactaaaaaatatcggagttccgtttcttgtagagttccgaaatttcctcctgataggtcgcgaaatgctgctccagcacattgtccaggtagctatacagcgagagttcgttcttaccgataacctgcactatccgggttatacgctcgtgaaactccttgcggatatacaccgttttgccgcttcgggtattggagggggcgttccggataaaaagacgctcgtaatcctggcctttccctcttcggcggcgtccctcctctttcgtagccgacgaggaggcggcctcgccggacggttccgatagagccgatgcctcctcctctttttccggcgtgtaaggatgtaatggccggtttcggcttttggcctggctgatgatgaaggaagcgtccaaaccgtcgtcatgttcttttccgctcatgagatcctactttaacagttcgatcaattcatccacgagtttatccaggttgctgccccggatcaaagaacggtctgccgggaagagcgtggagcggaagacagagcgacggctggcgttctgctcacgacgaaaacgcttggtgtcaggcaagaaggtcttcaggacaggaagatccagctctttcattaccgcctcgtaaacctgatataattctgtcttttcacgtccgtccaccatgttccatagcatatacagccctttcatccgggacttctcgcggcccatgatatgctcctttaccacaaccgcgtaattcagggtgctttccatgacaacccggtcggcactgatcggggcgacgagataatccattccggccagggaatgaatcagatcctcgttattgatcgtaccgggaaggtcgaagaacacataatcgaaatcaccttgcggcaggaggtagtcggcatcggccaacgcctctttcgtgttgctttccacgacaggataggctttcttttgaagccgggtgaattgttcgtaagctaacctcttgtaatgttcgtcttcgagggcaagcttcaggtcacgttcccgcatctccacgatggagtgttggggataatcgcagtcgatgaccgcgacattgaaaccctttacatagtgcaggtaagaggctgccagcaccgtgagggtggttttgcccgctccgcctttctgggtggagaaggccacgaatttcgttttctctttcattgttccatgcgtttttagttatacaatcgggtaatcgttcatctcttcacgtatccgggcaagtgagggcatgagattttatgcaggtatgccggcacgcatatatgctggtgcgctggcaggctgttacgccggtatgccggtgcatgggcgcgtgtccgattttatactcatgcgcaaccgcatttgcttatccggacaaagacccgctttttcctctgcacacggtgttttctgcatccgtccgcacgtgtgcggacagggggatgtgtcattgcccgtatccgttctcacgtgcaaagtaaacccttaaaaacacgggttgtatgctctttttccgctatggccgcgtgtggcgtcaaagtggacgcaagtggcgtaatcgcttatgacacaagtgattgaataggtaggtatctttgcctcgtgaacgatcccgacgctaatgaagccgtccttgccccgttttacggcggctctttcaatgttctgtccgcgagcgggcagaaggtatttgcaaagggcaaatagcaagctgtgttttctgctgcacgattctcgttttgcagcagaaaacagcttgcccgcaagggggagaaagcacctccggagtcggtgcttttcagaaaggcggcaagccgcgaagggatcggaattttcaggaaccggtggggccctggcctctccttaaaatttcgatgcgatggaaaagaacagaaagccccgagggggcaaagggggacgacccgcgaaaaacgacccggccgtttaccgcttttcggtaaacttttcagccgtggaacatgcccgtttcctcgacctttacgagcagtccgggctattgtccaaagccgcttttatcaaagcgagagtgttcaacgaggcgttccgggtggtaaagaccgaccggggaacgctcgaatacgtggcgaagctgaccgctttccacgcccaattccgtgccgtgggaacgaattacaaccaggtggtgaaggagctgcacgcgcatttttccgagaagaaaacactcgcgctgctctataaactggagagagcgacacgtgaactggcggccgtcgggcagcaggtcgtgtcgctctccgaagagttcaaacaacgatggtagccaatatcaccaccggaaaagacgtgtacggcgcgctggcgtacaaccaggagaaagtcgatcggggcgacgggaaggtactgctgacccacatcgtgagggagccggcggatgggcgcttcaacgtggccgcgacggcagaagacctcctgcgctggatgccctcgcactaccggacggaaaaacccgtcgtgcacgtgtcgctcaacccggctcccgaagaccgcctcgacgacgggcaactcgcggagatagccggggcctacatggagcgcatgggttggggaggacaaccttatatcgtattcaagcataccgacatcggacgggagcatatccatatcgtgtcggtgcaggtggcccaggacgggcgcaagataaacgacagcaggcgcaacgaacacagcgtggccgttaccgaggaactggaacgggagtacggactgcatcccgccaaagggagaaggcgggagaaagggcaagggatcgtccccgccgattacacgcggggcgacctgaaacgccaggtggcagcggtaataaaaccggccgtggcgacataccgcttccaaaccctcggcgagttccgggcattgctgtccttatataatataggtatagaggaagtccggggagagcggaacggaaccccctaccggggattgctctacacgctgctggacgagaacggggacaaggcagtggccgcgccgctcaaatcctcactgttcggtaaagaggtcgggtatgacgggctggaacggcacatggagcgcagcgccgaacggttcgggaaggacgacacgaggaggcaaatccgtggccgggtcgataaagcgcttcggggagaacccacggaggaagaactgcgcgaacgcctgcgggaagcccgagtggatctctacatacgacgcaacgaaaacggccgcatcgtgggtgtgaccttcattgaccacgaaacacggacggtcgtgaacggatcacggctgggaaaggcatactcggccaacgccttcgagctgcgcttcggcgggaaacggaatcccggggaaaacacgagggacttgtccccgaaacaagcgcctgccggacgggacgggcaacggaagcggaatacctcacgacggaggaaagtataacatctcaattatcattcatttattaaattttacggttatgcaacaggaagacgaccttcggggtcttgcaaaaacaatggatttcatgcgggcattgagtatcttgttcgtggttatcaacatctactggttctgttacgggcagatacgggaatggggaatcaatatcggcgtggtcgataggattctgctgaacttcgaccgcaccgcggggctgttccggaatatactatggacgaaacttttcgccgtcgtgttcctcgccctttcatgcctcgggacaaaaggagtaaaagaggagaaaattacctggcggaaaatcacggcatcgctggccacgggaggcgtgctgttcttcttcaactggtggctgctggacttgccgctgacggcgatggcgaacgcggctttctacatactgaccctatcggccgggtatatctgcctcttgatgggcggcgtgtggatgtcccgcctgctgaagaacaatctcatggatgaccctttcaacaacgagaacgaatcattccagcaggaaacacgcctgatcgagaacgagtactccataaatctgccgacgaaattttactataacaaacagtggaacaacgggttcgccaatgtcgtaaacccgcaaagggcttgcatctgcatgggaagcccgggcagcggaaagagttattgtgttgtaaaccagttcattaaacagcaaatcgaaaagggctatacccaatacatctatgactacaagtttcccgatctttcggaaatcgcttacaaccacctgctgaatcaccagaaaggttacaagaaaatcccgactttctacgtcataaatttcgacgacccgcgccgctcgcaccgctgtaaccccattcacccggacttcatgaccgatatttcggacgcctacgagagcgcctataccatcatgctcaacctgaaccgaagctgggtgcagaagcagggcgatttttttgtggaaagccccattatccttttcgcggccgtgatctggttcctgcgcatctacgacaacgggcggtattgtaccttcccgcacgccatcgagttcctgaacaagcggtacgaggatattttcccgattctgacatcctacccggaactcgaaaactacctcagcccctttatggatgcctggctcggaggcgctcaagaccagctccagggccagatagcatcggccaaaattccgctttcccgcatgatttcgccccagctatattgggtcatgtcgggcgacgatttcacgctcgacatcaataacccggacgatcccaagatactctgcgtggggaacaatcccgacaggcaaaacatttacggagcggctttgggattgtataattcccggattgtcaagctcataaataagaaaggccagctcaaatcgggcatcatcatcgacgagctgccgacaatctacttcaagggactcgacaacctgatcgccacggccagaagcaacaaggtcgccgtgctgctgtgcttccaggatttttcacagttgaagagggactacggggacaaggaggccgccgtcgtgatgaacacggtgggcaacatcttctccgggcaggtcgtaggtgaaacggccaagacactctcggaacggttcggtaaggtattgcagaagcggcagagcatgacgttgagccgcagcgacaaatcgacatccatatccacgcagctggacagcctgatcccggcctcgaagatctcgacgctcacgcagggaatgttcgtcggggccgtggcggacaatttcgacgaacgtatcgagcagaagattttccactgcgagattgtcgtggacaacgaaaaagtgaaagcggaaacggcccggcacaagaagataccacaaattaccgacttcacggacgagaacgggacggatcacatgaaacaggtcgtgcaggaaaactacgaacgtatcaaggcagaggccggccgcatcgtcgccgaggaactggaacgtatcaagaacgacccggtgctttgcaagctcctgccggaacagaactaaatgaacacaaacacccccgcaaacaacctccgtgaccttaacgggggctgtttcctgattttataaccgcacagccggtgttttggagcataaagtagtgattatgtgaacggaaaacattatttttgtgttcggaatccttttaattataagtatgacagttaccgatatatacgaagcaatgaacagcaaggcggaagcgtttttcgagtggttgcaggctcacccgaaatacgggttgctgtttggtgtcgggttgcttgccctatggcttgcagggttgctgttccgttggaaatgggcatgtcattggcagtttaacagcaaactgtggttatttgacgattgcaagcctgaaacacgccgcagggttcagattgtgttggtcagcgttctgattatacttatattggtcgatttctttgtatggagataacggtatggaaaaggacaatcgcaaataccggatctgcttcatcgactatatgtggtatgtagccgagatatggcacgaaagggagcgtaccaatctcaacggacgtatgctactgttttggtgctggctcttcgtcctactcataccgcttgggtttccaccgatattgcgccttttcggctggatgattggtttggccatagtgattcctctatgctttcttcccgatttattctgcaagctacgctatacagccggacggcgtgaagcgctccgtgaacattacgggaagatgaaacatcccggcaggaagctcgccaaaatagttcttatcgctatcgccctgatcgtggcaaatgtagcgctgatgttccacctcggatttatacataagccatgatgaaaccacaggaacataaacggcgcttttatctctgggactacctttggtggatgggggagaaatggaagcaggcaagacgaacaggcagggtcgatggcgaaatgatgctctcgatttatagcttcgctcttttgatattccctatgatgactgttactatccggctttttccaggtgtgtcggcattgttgccatgtgtcgtttttagcattgtcacatttgccgttatgtcgctcgtcagcaggatttacaaatggcgaggcaaagcagtgatgtctcactatgccaagtgcaggtttaacgaactccttgcggttctgttatttttccttgcgatggccattatctgctttatgatgtatcttcttgacaaaaagtgatacatactttgatacggactccgggccgttatatcgaatggtctaactcgatgtaccagtttcccttgatgggcttgtaaagcgtggtgtcgttgtacgtcctgcggtagatctcgttcaggtcgccatgttcggtgatacggatattccgacggcttctcaatccgggatcgtaaacgaaactcttggacgttccggcatccacgatgccgtgggagtagtacggcataacgaggctcacatataccgaatctgccgttccccattccctgcgatcaacaaggataaaaccgcatccaatctctgataacagggagtcgagtaggattcgctccggcttcaacagtccatataccgggatgtcttgttcatcattcgtttcatgggatgtatcgctttgctccattgaatcaagtataataacctcttccggagaaagcggcgggtagtgaaaactaccttctgaactctctgccatgatttcgtacaccttacggaacgccacctcgtgcgtggtgaaatggcgtatcatttcctcgtccgacggcggcatgggaggctctccgcagcttacggcaagcaggattacaaataacaggattatgactggtgttctcattttctaatgtttaatgttctgtggctaaccaatcttgtttagggagttgagccatttgttaatagcatccaatctgttattctgtttaatggtatcttcatttctacataatttgatttgccgaataacagagttctgcataattgaatcggatttgaaaagcagttctaaaacggcttcataacatttggaatatctggacaattcatccaatatatttgcgtcttttagaatatacaggttgaaattgtacacaaatgacttgtaactgaaaatctccgactgtaatgctgctgcatcaagacaagtataaaacaattccttatcgtgctgatatagccacatataatcagatgggttcaggttgtagtgcaataaagtttccgaacggacaaatggaagccccgtatttgagcctaccagataacggtatgtctcattgactattgactcaactatttcaatggattctgattgtttgtccgattcccgtatttctgtaaatgtatcggcaataagaacttccacatcctgcgatttgtaatatataccgtttttttgccagcggaatctacggatatattcttcagaagtcggacaacagaacagtaaagtatttaacaatcggttcagatatattcgcttatctggaatatgacaacggtgtaaccctattatggagccataagcgtatagctttccaaactcgttttcctccgaatttgaatttttaggcatgtaatacaaccgcacaatattggaaatgaaataatatatatcaagatatttcaatgtatcagccgattctccatatttgttaagtaaatgccgctccagtttctcgccataccataagtagccatcgggatttatttgaaacaaccgatgaaacttaggtcttgataatgaaaagttcttgtttctacttttcattcgttccagtaaggcgacaataattctattcgttatatccatagctgtaatgttcaatagcgttccgctttaagcagtagtgctgtttgttactaacgaattcattcattaattgatgctttcattttttctacaattacatcaatatattgttgtggaatgtttttatttttatagttctcaatagcatcaagaatactttgtttcaatatctcaacacattgagaatcatttgctgtttcaaatttatcaaatgggagtagaatttccaattctatccgattacgttttttcgaatatcgacttaatggatttgtagtaaatccttttaagcagaatacatagaaacttagttcattaatatatgaaatatcacatagacaatccatatattctattacagagtttcttgctttacgaaacttatcagaaatactatgttccaattcacctccaataaaaactttcatacaaatttgttatcgttagtaatgtccggcagcgttccgcctttgttcagtcgggttgcagcttgttagcatcgttttttatttacggtttttatacttgtttctcagaaatcccgtagttcttcgaatctatccagcaatcttgccttatcaattattggattattcatgtagtcaattattgaacacaatacctcgtataccagatcccgttcatcagtttcgatacatctcattcgattaaatgtctttgtatattcctctaccgcagcaattgctttagtctgcgcctccggatcattttgaacattcagggcgagtaactcgtttcgtgtcttcctgtactggataatggcctttttggcggaggagggtgagatataatcactgtcatcccaatctctgaatggattatccatattttcttttatccactctggttttcttgcctgcgtgacggaaagattcattccttcgttttttcgcttcttgtataatttttttatacattttgccgcatcttctggcaaacttgtcatccaaagccagtttagatgttccatccgttctggcacaggaatatcctctgaactgaagccaaaaagattcctcgttgcgaaaacttcaatgttcctaaaactttcgagtaccgagaagtttctgatatacccgggttttccccataaccagagttctttcagattagggtaaacggagaatatatcgttcatatccacttcattaatttctatgccatgaagactgttgagattggaaagttcaggataggggtgaaatattttacggtattgtaagagaaggttagccccgttatctcttgcatgaatgacacatggactaattttatcattcaaaagatataactgttccatttcatcattcaaccatagttcatcaatttcagtcaaatctatgagaagttttcgtaggcttgtaccacgaaaatcaagacttctttgtcctttacccttatatgtcagttctgtaataaacggtgtattatccaaatattcaatgagcccctgatgatattctttaagaaccagcgtagaaagacatgggaatacttttaattcatctgctttggaaaacgggcaatgggcgtcatctacatagtgcgaacttattttatattcagttccattaagccatactgtttcctcacttttcattgcaatcttaaacgcttttctcctttcttcaggaatctgttgccatttaatttgcctatatacatcatacccataattccctgtaccaaaatatgagttttcctcgtttgtaagaggaggaatattacctacaaatataaaataagctggaacatctatatcgacattggctatacataattgcctctcccaatacatgaaatccatataaagaggttggagattttccatctgtactagatgaagaggcgattctccagtccaatccaggtaaagacaaattgcgtcgcccttatcctctattacgtttgtaatctgacaggctgtataaagccttaaacgattattatagatagtatagacatctcctatctttgctttcatattggtttaattataatttttcgatgctaatggtttgcagcgttccgccttattcagtcggtagtgctgtttgttataaactcttttttctttattcttttgccgttacatgtaaagccataagtaaaagctgcatctatggcttgttttgcactctcaagaatataatgatacaaattatcatatttactaaagcatggagaaagaatgtagaagtttttaatatttaaaggaatataaatccccgtcatatcggatattccatagcgtgcttcctccaaatttggtactggtatggaaatagatatttcaaactctttattagatgggaaacgttttgcccgtttgaaaatcccaatccccccattagtatttcgaagatttatctgtatgagaagtttccaatctcccaaatcatctaagttgatttggttattgtaatcttccatataaccattcaactctcggtaaattgagcgcagtaagtccaattctccaagttcggggatttcactacttattaaaactgcatattgattattcatacattcatccttatatccagagtttataatgtttagcagataaactgccttaaatgtttcatctgtttgttagcaatcttttaagaaagcaacatgaagtgccattctttaggatagtccttctttatcatattgaacagcaactttacattattggaatgctgttttgtcaatatggagtatatatattcatgacaggcgcagcaggctcgttctttattagaagcaacacaatgaaaagaatcatctgtattttcctctacacaaaaccagttccatccatagtgcttttggatggtgtttcctaacagggaacctaactcataagccctatccgtaatttcctcgtcatctgaactttcaaaattattgagatagttctttatgccatcaaggatggcagaggattcagcactttcctgcaaacctataaggactaaacctttagccgcaagctgatctatttctattcgttcgtcctcattaattggacggtattctataatttcactcattgctttctttttttcgtcaattgctaatgtccggcagcgttccgcttattcagtcggtctgctgtttgttatcaacttatattttgtctgacaacaccatgttcataagccaaactatcacattctttttgcatattggtcagaacatcttcgaccacttttaaggaaacttcttgtggtacatttatggatacgaatgaagggagattagaaatctctaccttgcatcccatatcaagtagtttgtctctgaccatctgcatacgtttatcgttaaaatgtaccctcaatgtgctatttccagagggattcactatggattgaaaatgatattcgccatcttcttctgtaacacatatctcatcccccaaactgattccataggtatagaatggcacattatcgacaatataagtatcattacttgcctttttgcaccacaaaccttcaatagaaaatggtggatagccatcttcatcttgttccaagtgaaatagcacttttatatgtttgtcttttttcattttattcattaataagttgataatgttcggtggataatcatcattaaaggagattgatccgcttgttatctgcccgctttattcctcttcttcgataaaatgatttataaagtaattgaatgactgggcgatgtaacgagtatttgtttcaaagttgtattctcttgaagcgttttcgtcccactcgtcagtcaagtaatagtaaatctttttattcttcaagttcaacgcataatagtttccacccgaatccatagcaaaaggcaacagattgcatggcattaaattcctactccatatatctttggctatgacttcaattgtttcaaaagcattggtgcgttcctttatcggaaagaacgcatttatctccacccgatccaaatcctcgtcctgcggttgataacaatatggtgatggcataccaccgttgaacttgaggtaaaagttcttcatgcctgccggaatctttacattcaactcaacctcaaaattctttatatcttcttttgttagcgaagccgaacagtccgaaagttcaggcattacacctgctgtctccgtttgtccctcttcgatttcttctattgctggaattgctttgtgcccgtccaaaacaacgagattgtcaaagaaatcatctattgaatttgcaacaagtcgtggctctccaaaattgaagattacatcttgcatccccacaatagggtaaagatagatctttccattaaccaagtctatggtaatccgaccttcatcggtagattccatagcaaaaataagaatgctatcagatatagctccagcttttcttaactctaatgtttcgccttctgccgtatatctggggtcattcttaaaatccttgttatatttgaatgggaagaaatcttcaatttccacctcttgatatttatttatgcttgcggtctgtttcgtagaacctccattatattgtaaatagaactctttcagtctttccggcaaggcataacccaatttactctctatttcttcaaaatctttgagagtaagacttttttggcaattttctaattctattttcatattcattctttttatgggcagataatgtttggtggataaccgaccatttcgagagcaattaatccgcttttatctgcccattctattcttctcattgttcaaaatggatattattctctgcgacatatttcttaatcggctcaactatatcggtaacgtagtttgtgcacttaaaaaattctctaaatatccaacctccttcacttgctttggctaatggaaccaaagtttcttcaatgaactcttcatggttgcacaagagagaacagattactcctaagctaaactgtttatctgcatatatatgctgaatatgacccgaatttgagtaaaaatctataatttttgtatattgtttgacaaaaggtatgatatacggaaaaaaatcctttttcaaatcgtttaagaatctctcaacgttaggagtcttgtcactcttattcccgaaaaaataatccatatccattagatgctgcttaaaccaatcaatattattatcaaagcaaactatgatgttaccaccagcgtcttttttatttaatggttctgatacaagactacataaatatggattctttattttagctgatacacccatacaaaaagtgtttttaccggcatatccaccttgggttgtttgaaagtaaaactcaatactacaatcgttttccactatgtaagtaaagtagtctttattcttttttgctttgaccacatttacaggaagcatctcttgtattcttgtaaacatgtattttaggacttccgctttagtttccatatcactttttttagttcatattattgggcagataatgttcggcggataaaccaccttaaaagtttcatctgtttgttatcgacctattttatttttagtttttgactatatgcaagtattacaaaacgattatctaatccacaatcaattacatcattcttttctaattgagaataggcttttacaaatctatttcgacatttacttgaatgtatgtaatgattgaagtagttctcggcttgttccttttcaccatatctcaacatatatggcagggcaaggagagagtctttcgtgtattgattgaaacaacagccatgttgcgtaatgaagtcaatagccatttgtctattctcaaataaatcaaatatcggacaagcatatttttcaagtaaatcaattattgtttttattgatggagcatagcttagtccggcaagatcccaagattgatattgatttattggcgataggtatccaatatgattatgatatactaagccatcatcattgacattgagattctcttcttgcacccactttttcaagtttttacaggtaatcgtaatcagtggatatatagccacactacaagatgaattatatacacttgaacgaaaccatatttcaaaagtcaaatttttgtcttttgaaatctttttcaaacattgtccatttttagacggcttaaatcccattgcgataaaaggaatagctatctcattgcaggctttaataaatatatctcttggtttcatttcttgttcttttcaggtcgataatgtttggcagcgttccacttattcagtcggtttgctgtttgttatcaaattctcatttatccatttatttacttttttcgttacaaatgacattggagaaacacctgaattattattcactgttatatctgcaccattttccaataatgtaatcgcagatttgtcatttctatcaaaaatggcaatgaatagcggggtacgaccattttcttcttggatatttaagtttgcctttgaccctgcaagaagttctataatttccgggctattctcttgagcagcgaaatgcaacgccgtccacccagagtcatcttgcaaatccaaattcaaaccattcattttgtattgctttattagttcaatggcaaacgtactctttccttcgacaatgaaattcattaatagatttcttccatctctatccacaaaatcacatccatacttatccacaaatgatatgacttttgtaaaatcatcttcgtcgaataattcaaacatcagatcttctgctttttcgttatattttgtactcataactgctttattttagaatttgataatgttcggcagctaatcgccattttgggcgattaaggtgtatgttagcatcacttctaataaaagaatcacatatcagctaatttccactttacttcagaagctgatacatcatcatcaatatatgcttgcaaataagcagctaaatctttatatcgactttcaccgttgcaatcatatacccataattccggttcttctgtaccgtcaaaccatattaggcaaatcatttcatagccattatcgcttgctgcaaaaatggaaattctgtttggcgcaaatagtccagtagcatggtcttcccaataatcctttgaagcttttatgtcgcgaacaattcctatcaaccgttcatccttttcatcttcattccatggactttccatttcttttgtatcaagccaatctccatgtgtcgcattaatccatttaccaaatgccccatacctgattttcaacataggagagacatttctataaactcctttttcaagggtaggcactcccttatgaaagtcgatagcttggcttatttgaaccttaccttctaaatcaatgacttcatcaagcaattcttttattgttttcattcttttttatttgatgctaatgtccggtggctaaccgaccttttcaggggagggtaagccgcttgttatgtatctttataagttgggatgacttacccaattatattttttcattaacttttccattgctttattctctgcattattatttctgaaataaatatatacagatttcaaggttttcagatgaaataatgttttttccaactcttcggttgttagacatgttagttccgttgcgacaaaacgctgcaatttcggaagatatctgacactgtctataccatagcgcagattcgggcagcctgccaactccaacaattccaagttgctcagttttgacaagtctggcaaggtctcaagactgaaagtccagtgcagataaagtcttttcagattaaccaatttagatatccacgaaaaatccgagcatttcgtctgccttttcagatacagatattccaaattcggaaatttgtcaggcaaacactccccgtttgtcagtttggagaatatggataactttttcatattgaagttaggattcagactcgatgcgtccatttttttgacctccaattctttaagatttgtcaaactgttaatgacagaaagttgttttttagtaatttccaaatagtctccaaaattaagagcatctaagaactttaactcttgcaggctctgcaatgatatgcttcttttaatcagacctaaaattgaaagactttgcagtaatggagtatattgaacaaaatcaatagaatccaattctgctttatgcggaaagttggagacaagtaaatgccgtacattactcaaaaattcaataatattgagattgtatatcaaatcttcatcttcttgacttattcctaaatcacaatcaatacatatcatacaatcattcattccaagcaatttattaatggattgcaattgactcacagtatatccctgtgtaccagataattgtattgattctccttgtactatggttatatttgcaatttcctgtgaagtttgtttacgaatatatatcatattgaattttattaagatacataatgtatttcagctaactgcatttagctgttaagttgattgttaccaacatttattttttcaattctcccaataagcatatattggctatgtgatattaaatattcttcatttttttcttcgtatttattttctaaacacaaagcaccaccgacaataacatcaacattcgtttctaaatcaaaatattctttttcatatctgggtttcaaaattagaatacaacttttttgtccattaaaatctaaaaaactatcagatttgaaaagaagaaatgtaggagaaagttgctttattactataccatgaagaatattactaccattatgattgaaaccccacggttcatctactgttagtttgtacttgaccatatttattaattttctttagttggtaatgtttgtcagcgttccgcttattcagtcggtctgctgtttgttatcaatgccttaccgattataaagttgatttagcattttgaaataatcatttccaaacccttcaacataatcatccattacgccatatatgttgtttttactatcaacaagcaagaccatatatccatgttcgtattccccaaaaggacaaatatccgaaacatggagtagttcacaaaattggtcgtagaataagtaatgcggattatcgtttaatgttttctttaaattaaaatgcacatccacttttggaaactgaaattcctgattgtagaaataaataaggaaatctatcaactttgaagtcggttggtagtttgctttagaataaattgccacaagctcattcgggcttatgattacccgattttcccagtggcaattcgttttaagatattgcttcagttccatactacttttattttttattttgcacattgataatgtttggcagcgttccgctttttagtcggtttgctgtttgttagtcgcttattcccattcaaatgttgataagtaacgaagaccattatagtccgcaatctcttcaacatattttttaggtatgccaagatgacctttcatgttttctttaagaataaaaactttttggtttttctttttatctctaaaaccattcgggatatagcagaaagtacaattatttgaggcattattaaggccatttctatttaatgatttttcaacccaacaatcaagtacattattgtctattataactgattgaattaattgaacagaattcattgtacatgttttgtcaattttaattcttaaaaactctggataatagaattttatacctaagtctttacagaactgacaacgatgttcgggattgggacgctttttgctctgaccggattcatacgcttccaactccttgaggtattgctcttgattaaaatactccataaattcggtttcatttttatcggtatgcccaatccatgtcatatatttcaaaccggcagtcgaggctgttgtaccagtcggattaagttcaaaaataaaagagcccaagaaggataccgatacggtattcgtcgctttctgcaatgatataccctcatggctattatacatgattgccgcatttgcgacagttatttttttcgctcttagtatttccttgattttatctgtgtctgccggaataacattcaacagattctcaagtccttcagaagaatatttcataataagagaatcttcgtcatagtccattacaccaagctctttacagaactggcaacgaagttccttattgtcttcatcgtattctttccaccattgacggaaagccgattgatccatatatttctcaaagtcagcttcggaatcgaattgaccgacccatatcattatcttgctcattttctttttttatttttcaagcgactaatggtttgcagcttgccgccgtgaggtggcacaggtgcttgttatcagtcacttttatttcaaatcttctttatttatagtaattattctattcggtataaagaattgagatgcttccacatctatgctgtttgatatatagcacttccaaaatttcacgtatagaaatttctttttgattttacgaaaaaacttggaaaccatttgagaaaaatcattattatcagaacagcaataaaaacgtccagcaatgtatgccatatcttccctttgaaaaggaactctatattctaaaactggacttttcacatagtccaatacttcagctgttgttccatcataatattcatgtgtataatatgatatatattgttggaaagattttccggtcaaatacatcttccggtcattagcacaaatgtcaaaaggagataaatctcctttataatgtgggacacacaacaactctccaaatacacttctaagcgtatttgcaatcatctcatcatcatttttatgcgaatagaattcaaattgctttcccatgttctactggttttaatgactgataatgtctggtggataatcatcattaaatgagattgatccgcttgttatccgtctcattccttttttaatgatgaaataaacgattcaaaatcactcgccaataaggaaagagctacttcttccatttccaagaaatagattttaccttcagctttgtcaaaaacgaaataattgccgaatggatctatagcaaatggtattacagtattcgggattatatcactcaaatcagttattgtcgccgaatacgtcaagtcttcaaattctgtggactttatgggcagaaagaaatccaccacataatcctgactattttgagtgtatatcgttttatttggttgacctccgttattggcaagaaggaacgatttgatttcctgcgggaaaataaatttgtttttccgctcaacatcagctatatccttagctgtaattgattctgatttattgttaaattcaagttccattttattttttattttgacggataacgttatactatcagccgatttggctgttattttctttaagtatcagacctcgtcttcctccatcaacagatcgtccaacgggcttttgatattgcttttgaaagtgtcggctatgtggacatacctttccgttgtcttgatgttgttatgtcccataagctctttcacaatcttgatgtcggttccttgctccagcaagtgggtggcgaacgaatggcgcagcaggtgcggataaatccgtttcgtgattcccgcttcccgggccgctgccttcagccgtttcgacacgatactctcggtgaaaggttcgcccggtctgtgttcaaagagccacactttcggtttgtatagtctgttatattccgtcagctttttcatcaacggttttgatagcagggtgtagcggtctttttttcctttaccctgccgcacccgtatcagggagcgggattcgttgatgtcgccgggtttcagttccagcagttcgctgatgcgcaatcctgcggaatagagtatggagaacatacagaagaaacgcaggtctgtcaccgtcacgtcgagtattttctttatttcctccttgctcaacacgtcgggcagcgtcttctcccgtttggcacggttcaccttgtaacaccgccgttcctgaccgagaactttctcgtaatagaacttgatggcgttgatacgctggttttgctggcaggaggatatgtttttctcgtggatgagatacagcaggtagtcgtttatctcgccgggagtaaccgtttcaatcttacgcccctcgaaatgctgttggaaatcgcggaaataggaggtatatacccttacggtatggtcactgtaacgcacttgctgaagtttttccagatagccttccggcagtggcggccgtttgtcttcctctttacggggtgcggtttccttgatggcagaatagtctataaacgccatttttacatagcggtcgaagaactcggcaagcacgaaatcttctgccggcagataagccctgccgccgacaagcagtacgttttcttccttcgacagcgacaagcggatgtcattgtcattaccgaaagtcacttcgacaaattctctcccgtttcttatcaccggagaaagtttgatcttggtttttggggtatatatttccatgcctcacgttttgtcggatattgaaacccgttttcgcaaatttataaaaaaacacgggttatccatgcgctttattgacatttaacaatagatcccgactacctgacaaataaggtgaggagccacgaaaataccctctgccaaatccgtccttcccggcactccgtttctccgatttcctctgccctgcgccacaagcggccacttctgtgcccgatgcttccatagcctttccaactcttttacgttcagccggttccccttactttcgttcccgcatcgctattggtgctaactaaaaacactcgtaattatggacgaaaacgtaaagaacgacgctaaacaagtcatgctcgttcagaatgccgacgacggacgactacaagccgttaccggcgtggatcaggacggcaatatccagaccgccgaccccacggatcagaacgtggcgagcctgctgaacgtgaacacgcaggattcagccctcgaagccttcttcaaaaagttcatggaacaggcccagaaccccgtccacacgggtatcttcgtcatgacggagaatgccctgaacaaacttatccgcatcgacttcgacccggagattctggaaaattaccgtatcgacccctccgaacggctccagacgcaggagcagcggcagttcgagccgctggacgtcacgaagatagacctggcggatatggagaagaaaggtatccgcatggaggacatcgagccgcacctgaaagccatgtcttacggacataaatccaacgggctggtggagatgaaccccgaactggagaacgggatgcgtgtttccaccaaagggcgcgtgtcgctcgaagagcaggcggacggctcgctgcgcgtcgtgccgcattactggcaggaacgacccgacctcgacgcccccttccacggggtgctgctcgatgaggaggcgaaaacgaacctgatgaacacccgtcatgccgggaaagtgatcgacctggagctggagccgggcaagctcacgccctgctacgtgtcgatagacaaatggacgaacacgctggaacccatgcccgtttcgttactcgaaaaacgtgcccgcatcaaggaggccgacctctcggaaggcaagcagatggatttctacggcggcggcaaggtgttgctcgaaggatataccacccgcgcgggttataagcgggatgcctatatccaaatcgacgcggccgaacgtaactattcctttacctacgacggtttggatcgcaaccgctacgcccaggagaacaaggagatttaccgccagaaggccgccgagaaaaacggacggcaggaaactacggcctccgaacgacagcccacgctcacgattcaccggacaatcctcaaagcctccgtgcccaaagaggcttatgaccagtggacggaagcggtgaatgatccctccaagcgggcggatgtcaaggctttctacatcaagggcatggtcaaggacgggcagggtgagccgttcaacgcctgggtcaagcccaacttcgagcgtaacaagatggacttcttccgctggaatcccgaccgtgcgaaacggcagggggcggaggtcaaacccgccgttgaaagccgtacccaggtcgccgtcaattccgagggcaagaccgtcgaagcggtcaaaggtgtgaaagagccgctcaagcagggacagcaggaggccaccccggcgcagaagaaaaattaccgcagcagcaaaaagagcaactccaaaggtgccaaggtataacgtatgaaatggttctacatgcaggccggagccatgccgctcctgatcgcggcgctggctgccttgtacctccggccgggtaaacgcagccccccggagaaggcggacgacggacggctgtattacgacgggaacggcaaccatgtctattacgaccgccggctgatcgcccgtccggaaaaagagaaagaagaagaacaacaagaaaacaaccactgaaaaatccgaatcatcatgcaagtaattatcgcagaaaagccctcggtggcgcgtgagatcgccgccatcgtgggagccacgaaccgtaaagacggttttatcgagggaaacggctacgccgtaacctgggccttcggccacctggtcgggctggcaatgccccaacagtatggcatcgcgggtttccgccgggaaaacctgcctatcctgccatcatcgttcatcctcctgccccggcaggttcgggagggtaaagagtataaggccgacccgggtgtcgtgaagcagctcggtattctccgggaattgttcggcatggccgagcgcatcatcgtcgcgaccgacgcggggcgtgaaggggagctgatcttccgctacatctactcttacctggaatgccgcacccctttcgtgcggttatggatcagcagcctgaccgaccgggccattcgcgaggggttacaacacctccgccccggcaacgaatacgacaacctctacctctcggccaaagcccgcagcgaagccgactggatcgtcggtatcaacgcctcgcaagcgcttgccgtggctgccgggcggggtgtctggtcgctcggacgggtgcagacccccacgctggcgatcatctgctcccgttacctggagaacaaggcgttcaagcccgccgcctatttccggctgaagctctccacggcaaaggagggcacggagttcaccgtcctctccacggagaaattcgacggcagggagaaggcggaagcagcccgcgccgaggttatcggcgcccgaacggtacgcgtcgtgaacgtggagcgcaaggaggccagggaacagccgcctctcttgtacgacctgacgacactccagaaagaggccaacagtcggtatggtttttcggcagaaaaaacgctcgacatcgcccagtcgctttacgagaagaagttcatcacttatccccgtaccggctcacgctatatatcggaagatgtggccgaggagattccggcactcatcgggaacatgacacgctatccccgtttcgcggaatacgcgggcaggatggataccgcatctctctcccgccgaagcgtggacaacgaaaagatcgccgaccaccacgcgctgcttcccaccgagaacctcccttccgaactggatgccgaccaccgcatcgtctatgagatggtcgcggggcggatgctcgaaaccttttccggggcctgcgtgaaagaaaacacttcccttaccctgcaaagcgcgggacatgatttcacggcccgcggcagtatcatggtcgagacgggctggcgggccgtcctgaatgaacctgtcgaggagaaagaggaggacatgaccctccttcccgacatcgtgcaaggcgacgagctgcccgtcaaaggatgcgtcacggaacagaaacagacccggccgcgcccccttcacacggaatcgagcctgctggcggcgatggaaaccgccggacgcgaactgtccgacgaggccgaacgcgaggcgatgaaggatgccggcatcggcacgcccgccacccgtgccgccatcatcgaaacgctctttgcccgcgagtatgtcaggcgagagaaaaagtcgcttgtacccacggacaagggactggccgtgtatgccgtggtcagggacaagaagatcgccgatgtcgccatgacgggcggctgggaactggccctctcgaagatcgctaccggggagatggacgccccgacgttccatcgcggtatcgaggtcttcgcctcgcaaatcgccaaagaactgctggaagcaagaatcgacggcgcggagagtgacacagcctgcccgcgttgcggcaggcccgtggtgttctatcccaaactcgccaagtgccagaatcccgattgcggcctgaccgtatggagaaccgtggcccgcaaggagctgaccgacaagcagctcgcggaactgctgaccaaaggcaaaaccggcacgatccggggattcgtcaaaaacggcggcgggacgttcgacgcggccctcacgctcgatgaccagttcaagacctcgttcgttttcgagccgcgcgatactcccaggcagggaaagaggaacaaacggaaataatcgttacctttgccactggaaaagacctgtcataacgagatacgcttgtttgataaggattttttcagtggtcggcgcttcgggtgggaacccggggcgcctttctcttccccgattatcaacgaccactaaaaattcttatcatgccagacaagcaacaccatacccccacgggggaattgtcctattacggactttcgttactatcctacctcaaggacagccacccggaactcatcgccgaaggtgagttcatcgccgagcgggccgacagcgccgcccaagcgtacagcgaggcgatccgttcgggctgcaaccacatcgaggccgaagaaattgcccgcgaggaactctgccgcggactgcacttttcaccctacaacacgctggtaaacatcctctggagggaattcgaggcggagattcccgaggataccgcccggcaggcggctctacgcctgctgcccctctgccgcggggtgctggagaagtacgacctcacggacgacttcgctgacacgcccgactacgaactgttctataccgaactgacgggaaccgtccaaatacttctcgaagatggcattcaataagaaaacccacctccgccagaatatcgacgcgctgaagacggccttcacgctcgacagggaacggcgggcgccgactcccgaagaagaaaggacactcggcgcatacagcggcttcggcgccatcaaggaagtgctggaaaaccccaccgggaaaccggacaaggacggcatggcaacgctcgtggccgagttgcacgaggtcatcagggcgaatactcccgacgaacgggaatacaagcgctacatggacgggatcaagaactccgtcctgacggctttttacacgcccccgaaagtggcagacgccatcgtggaggcgatatgggacacacggattgccccccaacgtattcttgaccccagtgcgggaacgggggttttcgtcaatgccgtggatttccacgacccctacgcggagatcacctgcttcgagaaagaccccgccacggggttgatcctgaagcacctgcaccccgaaaaacgggtgcggatacagggattcgaacgtatcgaacccaaatacgccggttactacgacgtggccgtgagcaacatccctttcggggacgtggcgctcttcgacccgttcttctccacccataccgaccccgtgcggcggcaaggcacacgggcgctgcacaactattttttcatgaagtccgtcgatatggtacgcgagggcggcctagtggcattcatcacctcgcagggagtattgaacgccgagcagggacgccccgtgcgcgagtggctgatgaaccgctgcgagcccgtatcggccatccggctgccgaacaacctctttacagaacacgcggggacggaggtcggcagcgacctggttatcctgcaaaagaaagccgccacgggggaactgtccgaacggcagcgggatttcatcgaatcccgcaagctgtcgaacggcatccggataaacaaccttttccagtcgttcgacagggtgatccataccgaggccaaagtaggcaaagacccctacggcaaaccggcgatggagttcacccacgcggagggcgtggacggcatcgaccgggagatgcggcgtatgctctcggaggatttcaaccggcatttcaacgagagttattgcctggaacatgctccggaacagacacccggtacaccggagcgggaattgtcccgtccccgtcaggcggaacgccagcgtgccgaaagacacgagccccgccttgccggagaaatcgtcaaggagattatcgccgacgcccgtaaccttcagcagcaacgggaagaggaggaaaaacgccgcgtcgtcgccgaaatggcggcgcagggctaccatgtcgataccgaaaccggggagattacccgaatcgaaaacaaacccggacaagcgttaccggattctgccgccacatccgccggagaaccgaccggggaggatctggccgacttcggggcctggtcgaaggagcgggagaatcgcttgtgggagcaacacccgccgaaacccgaagatttcggcatggcggatactcccgtgcagcacgtgggcggaacaacggaaccgaaaccgcgggagggcttcgccgggtcgcttttcgacacggtggaaacggcggctcccgcacctgccacccaagctgccgaaccggtaaacgtgcagcaggaaccgttgctgacgctctacgacctgttcggcttcagcgccgaggagcggcggcaggcagaactcggtatatccaagaaaaggaacagccgccggggagcaaagcggaagacgccccggcaaccctcattattcgccccagcctcctctccggaggaacagaagagcgaaatgccgaaaacgacgccaccggagcgtgatcccgaagacttgtatgcctccctgaactgggaggacaacccgccgatcaacggcttttacgagatgatgatgtcgcttaccccggaacggagggcggaactgcgccgacaaagcacccggcagcaggaaaccccggaacagcgggaacggcaggcggtacgccccccgacggaagccccgaaagacagacgggaacaagccgccggtacgccgagaacgggcagcttgttcgacacgccggacaatccggaggaggaagaacccggtaaagaaacgccgcagatacgggaggcggatatgaaaccccgcccgttcgagggggaggtcgccccctatttccgcgaagggacactcgtcacggacggacaaaaccgggtcggctacctgcgggggattgaatccctgcaacccatgttccacccgctggaactcacgcctgcacaacggacgaaagcctccatgtatatcgagatacgcgatgcctattaccacctttataacaacgaggcggaaacactgacggcgaaccccgccctgcgggagatgctcaaccggctttacgacaatttcaccgaacgcttcggacggctcaatgacaaacgcaacctcgacctgatcaagatggacgcgcggggaacggagattctatcgctggagcgttacatcgacggcaaggcacgcaaagccgacatcttcgagcgtcccgtggccttcaatcccgatgagatcacgcacgccgacgacgcttcggaggcccttgtggccagcctgaacaagtacggccgggtggaaccgcactacatggcctcgctcacgggaactaccgtggagggaatactcggggaactgaaaggacgtatctattacaacccggaaacggacggctacgaggttgccgacaagttcatcgccggcaatgtcatcgggaaagccgaacggatcgaggcgttcctgcgggagaatcccgaccacgccccggcccgggaatcgctggaggctctgcgcgaggcgacgcccaaacccatcgctttcgacgacctggacttcaacctgggcgaacggtggattccaaaaggtgtttacgagcgtttcgcctcctcgctcttcgatacggaggtgaagatcaccttcgcctccaacctggacgagtacggcgtgaaggcggaagcgacgaacgtgaagatcacggagcagtatgccgtcagcgcgcagacccgtaagtacaacggcctgcaccttttgaaacacgccctgcaaaacacttcgcccgacatcaccaagaccgtcctcaaatgggtggacggcgaacggcgggaggtcaaagtgcgtgacggggaggccatacagctcgccaacagcaagatagacgagatccggggtgctttccccgaatggctgcgcgagcagtcgtccgacttcaaagaccgcctgacagacctctataaccgtactttcaactgttacgtgcgcccgaagtacgacgggacgcaccaggaattccccgacctcgacctcaaggggctgggaatagacaatctgtatgacagccagaaggacgcgatatggatggacaaactgctcggcggcgggataatcgaccacgaggtgggcggcggaaagaccctcatcatgtgctgcggggcctacgagaagaaacgcctcgggctggccaataaacccatgattatcgggctgaaagccaacatccatgaaatagcccggacgttctgtaccgcttacccgatggccaaagtcctctacccgggcaaggaggatttcacgccccggaagcgtgagcgcatcttccgggagatacgcaacaacgactgggacgccgtgatcctctcgcacgaacagttcggcatgataccccagtctccggagatacagcaggagatattgcaggccgagctggactgtgtggaggagaacctcgaagtgctcaaagcacaaggcagggacgtttcccgcgccatgatgaaagggtgtcagaaacgcaaggccaacctggaagccaagttgcagaaggtggcgcacgcgctggaaacacgcaaggacgacgccgtggacttccgcctcatgggtatcgaccacctctacgtggacgagagccataaattcaagaacctgactttcacgacccggcatgaccgggtggcgggcctcggaaatcccgaggggtcgcagcgggcgctcaacatgcttttcgcgctgcgtaccatacagcagcgcacgggccgcgacctgggggcgacgttcctctcgggaacgaccatctccaactcgctcacggaactgtacctgcttttcaagtacctgcgcccgaaggagctggagcgtcagaatatccgcaccttcgatgcctgggcggccatatttgccaagaaaaccatcgactacgagttttccgtgaccaacgaggtcgtgcagaaagaacggttccgatatttcatcaaggttcccgaactggccatgttctactccgagattacagattaccgctcggcggaggatatagggatcgaccgaccgcaaaagaacgagatattgcacaatatcccgccgacaccccagcagacggagttcatagaacgactggtgcagttcgccaaatcgggcgatgccacgctcctgggccgcctgccgctctcggagcgggaggaaaaggcgaaaatgctcattgccacagactacgcccgcaagatgtcgctcgatatgcgtatgatagaccccgaactatacagcgaccacgtggacaacaaggcgagccactgcgcccgtatgattgccggttactaccgccgtttcgaggcgtacaaaggtacgcagttcgtattctccgacctgggaacctacaaacccggagcggggtggaacgtctattccgagatacggcgtaaactcgcggaggattacggcataccccaaagcgaggtgcggttcatccaggaggcgacctcggaaaaagcgcgcaaggagatgatcgccggtatgaacaccggaaaaatccgcgtactcttcggatcgaccgagatgctcgggacgggagtgaacgcgcagaaacgctgcgtggcgatacaccacctggactgcccctggcgtcccagcgacctggagcagcgcgacgggcggggaatacgcaccgggaacgagatcgccaaactccatgccgacaacaaggtggacgtgatattatacgccgtcgagaagtcgctcgacgcctacaagttcgggctgttgcacaacaagcaactgttcatccgccagctcaagaccaacaacatgggaagccgtaccatcgacgagggggccatcgacgaaaagagcggcatgaatttttccgagtatgtcgccgtcctctcgggaaatacagacctgctggacaaagcccgcctggagaagaagattgccacgctcgaaagcgaacgccaggcattcgtgcgcggcaaatcatcgagccgctacaagctggagcagatcacggagaagatagagaagaacaacgacctgatacggcgtatcggcaaggatctggaacacttcaaggcccgcgtcgagttcaacgaggacggctcgtaccgcaatcccgtgaaactgaacgggctggaaacctccgaccccaagctcatcgggaaacagctcaaccatatcgccgaaacggcacgcacgctcgacaggctcgaacccatcgggagcctctacgggttcgagctgctcgtccagagcgaaacgaccgggaaagacgggctcgacctggtgcagaaccgtttttatgtccggggtgaaggggattatctataccagtataactacgggaatatcgcctccgacccgcgactggcggcgatgaacttcatccacgcgctcgcgaccatcgagccgacactggagaaattccggaaaaagaatgaggaactggagaaagatattcccgtcctgcgggaagtggtggaaagttcctggcgcaaggagcccgaactgacggccctaaaagctgacctgacggaaatagaccgcaggatacagcaaagcctcaaaccgatagaagagagcgagggaaaggaggcggaggaggataacgacgtgtgccgggaacggcatgacacggcggaagagctcccgaaggaagacaacacggcggcccgtattccttcccggctgcggcagattgccgacgcctccggggggcgcatcgtgatcgcgggcgtgggcagcccgccggagaacggccctgcgaagaaagggatcaagatgtaaacgaaaagccgacggaagtacagatttccatcggcttttttcatatgtccgtgagcgttgtcgtcacacttcctgcaagagtgtttgcagctcctcctgcgtgggaagataggtcatgtactgggcggcgaagacctgcttttcatcttcgggcagcgtataacggacgaccgcgtcgtttttctccgcgcagaggacgatacccaccggagggttatccccgggattcatcaactcacgggtgtagtaattgacatacatctgcatctgccccaaatcctgatgggtcagctccccggatttaaggtctattaaaacgaaacaacgggccaggtaattgtaaaagaccaggtcgatgtagaaatgcttgtcatcgaaggagatacgcttctgtcgcgcgacgaaggcgaagcctttcccgagttcgagcatcaagcgctgcaagcggctgatgagcagttgctccagatcggtttccagaaaatgctctccctgcgggataccgagaaactccaggatatacgggtcgcggatgatctctttgggttcgacacgtccgggttcggtacgggaaatctcctctttcacagctttcttgtctcggctggccagcaggcggtcatagaaaagcgtgttgatttggcggtcgagctgccggacactccagttttccttgacgcactcgtgcaggtaaaaatcacgggcggcatcgcccgacaccttgagaagcgtgcggcaatgcgaccagctcaatttatcacacagcgtgtgatatttcgggtagcactggtaaaactgcctcatgtaccgcaggttggtggccgtgaacccgtttccgaactccgccacgagccgcctggaaagggtgttgatgacagccttgccatatccggcacggtcggttccctgctgctcgtactccactatgtatttccctacctgccagtaagccctcacgagggtcgaattgacatgatgtatcaccttcgcgcgcgcttcctgcaagatatggcgcacattatgcagcagctcttcctcccctttgtcggcaggatatattttatcagtttctttcattgcttcattattatataggcttcattcagcaaacatactgattttacggcaaatatcgagcggttgtaccgccttgtcgtgccttattccatgtatctccgcgtttttccatgacgccggactctcgggacagggcctaaccggaaccggcaggacgatcctttttcagcttgcggaaattactgaagttacgctcgatgaaccgcaggacgtccgattcccggtagaaggtcttgtgatagatcatctcgtaaggcagctctcccgaggtgcggtaacgctggagtgtgcgcttgctgatattgagcatacggcacaggtcgtaattgtccagaagacgctccccgtcaggcaggatggaaagcggttgctccacgtcccccgcgcacagcttctcgatacgttccagccgttccgagagccgctgcatccatccgtcgaaatattccttgtccagaaacatggcctactcctttggttggttcttgcgccgcacggaacgctccttcagcacacggcggatttccgtgagggaataatacagcttccggttgatggccgaataggtgatcacgtgatccgagcggaggcgttgaagggtacgcccgctgatacccaggtaacggcagacctgctcgccgtccatccattcgtcgtttatatactccttattccatgcacgccccttttcagggagagaggcgattgcagcctctattttctctatacgcccgacaagctcgttataggctcgcgaaccgatcactatgattttcatactcctttgttttttagtctgttacaaaggtcgggcttatatggacagcttaaaacgaggtcggtacgacttttttttgataatttgcagtgaactgattctcaacggttcatgcggtgaagaaggcagtgttttttaccgaaatccgcggcccgtactcggtatttttatgggcagaaatgcgatagaatactgtgattcaacgcttaacggtgttctaatccggacggggctacaacggaacacccgtatcggctccttatacgggtgcaaatacgggcgttcgggaaagttcctttcgagagttacgggggaaaaccgacctcggttcttttgttatatacaacgctgattatcagtgtttctataaggaatagagtgctttaccggttcatattctactcggaattgccgtttttcttgtttcgcttccacgtctgcatacgtttaagcagggcctctttcgccttgtcaagccacggtgtcgggttgtttcggattttcatatcgcagaatgtcctcgaaaggttcatgtcgaggtgtacgttgaaagcgttggaaatgtagctggcaagttgcgtgagtggcacattgccgaaacagcctttactgtcgagcaggtaaataagttccgtcagatccgtcttcgagtcctgccatgtcggacgcacgtcagacaatggcagaaccatgttccggaggttcgtgctctccagtgattccaattcgcccataagataaaccgacaacatatcgttggccaggattttcgccaccttgaaatccgcgtttgtcgaaaactgcgggtcgagttcatagtagaaggtttccaggtattgctccgtgtcggtctgcccgcgcaggaaatagaggctgtccaggtgtgtagcgccgctgcggaaatagcggataaagtcaaggcgtttctgcgtgtacgcgttgatggcccgaacatgggcgtccaggtactcccgttgtgcctcgatacttcctaccggacggttcatctcgatattgtagagcttgcggtaatagatcagacggcaaaaaagacgaggtttgatttctttgaagaactttatttcctcgtcatcgttttgaaaacggtagccgatgatatattgtttcaaacggtcgaacgcttctcccaggacacgtgacgcttcaagcgactttttcaacacgtcggtatcccgcgattcgatacgttcgatactccgcaggacttcgctgtttaatttttctataaatgcaatcataatccgtcttgttactttcgcgtataaagttagcgaatcgaaaaaccggcggattacgatttttatctttctcttcgtttttttatcacggagccgattttaatgtcagatccggctttcctgacggatggaagtgggattgctccccatattccgcttgcaaaagtccgtaaagtgggattgggcggagaaaccgcacatgtaggctatttcctgcaacgtgtagtgtgtcgtccgcagcaactccccgatacgttcgatacggcgctgacgcaaccacgaggaggccgagcagccgaaaacccgctggaaacgccggcggaaggtaatcgtgctggaatacccgcaaaccccagcgagttccgtgacgttatccgaggcaagataattcgatttgacacgggagatgaactcgtaatcgtcccccaggtgcaacagctcctcgaactccccgacatcggcgggagtgagatgttcataagaggcgtcgagcattttcagcatgacagcagcgttacattcaacgggcatacccaatgtcttacgggcttcacgcaggtaattcttgaaccgcagccgcagcgtgtcgtgatgcgggtaggaacactgggacagaatggtgcagaccgtccgcagttcatcgacacaacagtagccgaaataccacgttacaagacgctcgacgtaatggacggcatgaaactcctccgaaagcatcagaagaagcaggaacggggtgaaatcctggtattcccccgttatgggacggggtgcttcgtcaagcaaggaggcaatgtcccgcatcagaagagaatctcccgagtacgcttttatttgttcggaactgcgggcataatcccggtaacgcgatatgaccgccgacaaagcattgaacttcacggcgtgaacgccttctataaaggaagggcgaagactgttgtaaatggataagtcggtttgcataagtcatttctatagaacggagccgcatccccttgttgccaaagctccgcaagtcgttacttatgaaccgcttggaacacggtacgaatcctaattacaaatatatcgtatccgacaatccggaacaaatatcagcaggcaaaaatgaaaataaacctcgttatttttgattattacctgcaataatattatatttgcaaacaaataagagttgtttgacagcatgagaaatatagtgtatcaaagcactttaccaatttcttatccgttgcccattctcatgcgagtttcttttaatctatttgtagtcaattaaataccttcagactacatcaaatatacaaaaaaatgtaaatacagtatgagtatccttgaaatctagttaaattctacttgaggacaaagaatgtcctcactaattatccgcttcgcaaatgatatattgataaaggtcggaatgtccggttttatcgattatcttatgcttttcgagttggaatttcagttgggccaaaccaagagcaccaaagccgggaaggtctaataaagaatcgagtccgtttttgagggcgtaacgtagaatatcttctatggtttctatattcaaggttgtaaggcatttacggatatagggcgctaaggtgagacgggtaatgggttggcatatccgtttcgcggcatttaagggaacgggagtaagtgatcggggagattcgatacatagaccgttttggagcgcctttttatataatcttctcaattcgtattccatgttcctgttctctatccacagacgttctatctcaaggtcttgattcgtgattgttttcttgtattcggtcaggaagcccatgttttcttgcaagcggagcgatatgaccttatatcggcgacagattccgtcgtaggatataccacaacgtttggctacgtcttctatcttggctccggaagttatttccgtaaagataagtcggtctttcttgtcgtgtatgaatgttgatagttcggcgataatgagtttaagtaggggagagatgtttttaagggatcgcaggcagaaaaggtaatcatcgaattgggagatgatctcgtttatctcttcttccttgtcttggatgataagttgcaggtatagcttttgtattcccatacgctcgatatgggaaataaattcacgtaaattggtcagatcgactaggcgaacaccttgcttcacgacgtaagatgttatttttttagatatcgcccattgctggatttcttcagatggaaagccggtgatacaagcggcttcttcaatagtaataaactcaggcataactatttgattaaagtaaaacttatactatttatctttaaaaagggcgttatttggcgttatattgaagagctggcctttcattataaaataaagaaagggcgattggctgaacattacgttgacaaaggttccgctaaaaacccacattagagtaaagtcagccgcacgcccccctttatctatatacaataatcttatccatactttaacagcatagataacacgtatattcggtaaagggttgcggggccttctttgcgcttctctaaagttgaaaaatttagcggattctgtcaactcgcacaaatatcgcacgcaacacaaggcttctaacttaaaagccttttattgtcgcaaatatacgtatttaaaaatattttagtctataataatccatacgttttctattttatcattgttttactaccaacaaagaaagaataagtagataaaaacctatgcttttaccttttgcttttctgtcttaattactagctaggcaaatatatgatatattctttaattataattgattattaaggaagaaatcaagatggcaatccatcaaacagtacgaagactactaccctaaagtttatggaatgaccttacaaaacacttttatagtgcaaaaaagattaggtacattgccaaatggcttttttaggtagaaagttaccagttaactaacatttcaaagtaagttagcttcaacggcaaagtaagctaacttaaatgaccaagtaagttaacttcataaatccggggtgaaatccgcaaacgacatacaacacgcatctacactcccaacactatataaccgctatggatatttgaagtattgataataggcggtttacttctgttatccgtaactccaaccttatcagtcaacaagcctttcattaaaagataagcacatcataatggcacgactgtgccatcctagtggcacaccattgccataaggaaggcacagctatgccacgccaatggcactgccgtgccacgatatgggaaatgattggcactgcggaagtctgttaactagacagttaaggatggataaataattattcccctaacttatcaagcaactcatacgacggaacgaagaaaagagttcccgttatcggcgtgctgaagtccagcagacgatccgtattgcctacgggatcaccgacgaacatattctccagcattcgtcgggtggtgctgaacgtgctggcataggcgataaaataggtaccgtattcacctttggaggtatgggcgaatggcatgttagcacggactattttcagatcgtctccgatgttcgtcacggcgttatgggcgttcttcggtttttcctcatctgatagctcgacatcgttgaatttacgtcgaccgatgactttctcttgctcttccactggaagcgcattccatgccaccatatcatgaatgtatttttgcacaaatacataacttccgcccataaactcggggtcctcatcgcctattactgcgaaacgataggggtcttcatccacggcagggttctccgtaccgtccacgaaaccgataatcgccttaccgtctctataccgaaaaccgtgggtctcatcgatcgattccacgacaccccgcagtttctggtctataatggaggcgaactcaaagcacagtcccatctgcttacagcggatgtggaacagtaaatccccgggggtagaaacagccgtaagcttaactcctttgatctcttcaaacggttgcaattctttggggtttccttgctccgggaagaagcgtttccaagcatccgccccgaatcctatcgtacaactgaattgcatatcaggatagcgattgcgcatactacgtatcaaagcggagaaattagcgcacacgtccttcaccttatcaatcgtgtcggggagatcttttagagcatagacaatgaaaaccgcattctcacccggtttttgggtaacatcttgcggatagttagcgttcaatggattttgtagagagttcatagcacatctttaattatattgttattatatggatataactctatagatgctctcttgttcaaggaaatgtaacgaaaaatgtcctagcggttatttttcaatatctagttgtagagacggggcgtaccccgtctctacaactgggtagttatttcacctccacgctgatcttctgcttgatatctgaggcggaggctcctagttggaggatgaactcgccgggttctacgacgaattggctttgtgcctcactatagaaagctaaagaggatacggggatgtccaacgtgattcgccgactctcgccgggtttaaggaataccttcttgaagccctttaactccttgaccggacgcatcacggagcaaaccggatcgcttacatacaattgggccacctcagctccttcacggtctccggtattggttagggtgaaagtcgcttggatcgtatccgcttgatcgtacgtctctttatccgtattcaggttggaatagtcgaatgtcgtataggataagccgtaaccgaacggataaacgaccggaagccccttcgtatcgaaccagcggtaacctaccaagatatcttcctcataattcactttcaaatccctgccggggaagttgcccaacgcatgcgccggagattgatccaagctcacgggagtggtgaacggcatcttcccgctcggattcaccttgccggataatacgtccaccaaggcatttcctccttccatgccgttgaaccaagcccaaacgatagccggggaacaaatatccacggcggccatattcagcggcgatccggcgatcatgaccacgatcgtacgaggattcgcctttaccacctcttgaatcaactcaacctgtccgtaagggatatccatattcagacggtcgaacgactcggtatcataatcatggttcaaaccacaaaccaaaagggccacgtcactcgtgcgggcaacctctaccgcctctttcaataacgcgtcgctttcctgtgtcttggaagagaaagtaccagagctttgcccattattgcttccctccacgaaagtagataacttctcatagccttgggcaaaacggatatccaccttatcgccccatttcgcacgaagcgcccctaatggagttacctcgtaaaccgccttgatctcggaactcaagccaccattggaatgtttgcgggtagcgttatcgccaattaccgccagactcttgatcgaggagaaatccaacgggagaagattattctggttcttcaataagacaatggcttcggcagccgcgtcgtaagtggcttgctgatgctctttcgtattcatggagcccgggccgaaacgctttttcgggtccaagacattcgtcttgatcatcacacgtaagacatcgcccaccttctcgtccaccaagctcataggaaccttaccggacttaacagcatcgatcaaggggttggcataataccaatcctcatatttatcaatcagcgtgcccatctccagatccaagccggcctccatagaaggaaccgtgctatgagcggctccccaatcagttacatatacgccatcgaatccccattcattccgaaggatcttgcgaaccaagtagttattctccgcgcagaactccccacggaatttattataagcggccattaccgtcaaggcgcctccctcctgtacggccgccttgaaagcgggtaaataaatctcacgcaaggcacgctcgctacattccacatcgaccgtcgtacggtttgtctcttggttattcacggcgaaatgctttacgctacaagccacgtcacggctctgcaagcctttgatataagcgaccgccaatacggagttcatataagggtcctcgctcatatactcgaagttacggccacaaagcggggagcgaatgatattcacgcccgggcccagcaacacatccttctttcgccagcgagcctcctcgcccagcacctcgccccggcgataagccaactccgggttccaagcggcggcgaaagccgtgccggtcgggaaataagaggcggaatcatttgtccaacccgcatacgcccaatcgtggcgattgatctccgcacgtaccccgtgaggcccgtcgctcaagctccactcgggaatccccagacgctctactccggcaacatagaattttgagttaccatgcaacaacccgaccttttcctccaaggtcatcttcttaatcagtttctcgatacgtttctccatttgtaccttctctttatccgtgacctgcgagctcgcggcagccgcgttcaagaatagcccgcaagcgatcacgcctattatctttttcatttcctctttatttataggtttattattgcgcttgaatcgttaccgtcgcctcgggtaagccctcggctatggcttttaagtggatgtcgccttgtccgcccttgttccggatcacgaccaaggcttttccgtagtaggcttgccgtttcggtttacggaggctgttcggatcgttcggatctccgttatccgttccggcgatctcacccgggccctccacggagaaacggatcaacggggtagcgtcgggaacccggttaccatcgatatcgcatacatctacggttacaaacgataggtccgagccatccgcttggatgacgctacgatccggggtcaagaccaaacgggccggctctcctgccgtatggatctctttcaccaagacctccttaccccctaagcgggagacggctctcaaggttccgggcgtaaaaggcacacgccaagagacatgataggtactgtccgttttttgtcgtacgcctaggctctttccgtttaggtatagttccacctcatcggcattgttataataggcccagatatccacccgttcgccttccttccagttccaatgcgggaaaatgtgcaatacgggttcatccgtccactcgcttttatacatataatatacatccttcgggaaacccgccagatccacgataccgaagaagctgctccggctgggccaccaatagggggtaggctctcccaagtaatcgaaacccgtccagacgaacaggccggatacatgcggaagcgtcttcaccagatgccaagtcttctcgtgcgtagagccccaaggtacatggcaattatcataagaggagcaaacatgctcgggagcctcgaaaggcttgtcccacgattccggacggatataaatatgatcggacggcatctcataatagccacgggtcatcaaggccgaggtagattcgctcacgatcagtttccttccggggaaattccggagaaacggttcaagatattgctcatggtagttgaagcccagcacgtccaaggcatccgagcggaacagatgattcgcagggtttacctcgttacagccggcggtaacgacccgggaagtatccagccgtttcacgatagccgccagatgacgggtgatcaaggattgacgactaagggtcgtatccttcagcaaagcgggatcaatggcatggcccgcattcaagatcaggttcgccgcttgcagatccagctcggtagcgtcggcatgactccattgctcaagtacctcattgcctatactccacatgaaaacagaggcgtgattccggtcacgcaagatctcgtccgtcaaatcccgctcatgccactccgcgaaataccgggcgtaatcgtatggggacttacggcgttcccacatatcgaaagactcatcctgtaccagaaggcccatacgatcgcaaagatccagcaactcgggtgccggggcgttatggctggtacggatcgcgttcacacccatctccttcatgatctgtagctggcgctcgatagcccgtgtattcacggcggcacccagacagcctaaatcatgatgcaggcaaaccccttttatcttcaaaggcttatcattcaaataaaagccggtagcggaatcccaacggaacgtacgcaatccgaataccgtctcgtaacgatctaccaccttaccagccactttcacttccgtgacggccgtgtagagcgagggagaatcggggctccaaagcttgggatttgagatcgagaactgatgatcgacagatgcctcccgcatacgggtgtcgtaacagggcgtatacggtacccgtaacagagttgttacgggtgccgtaacaactctgttacggtcatcgtaaatagaggtagagacttcggcctccctatccgcctccgagctattccttattctcgcctccaaggagaaggtagcctcctccggtgagatcttcatatcatgcacgaaagtgccccagttgtccacatgtaccggattcaccttcaccagccatacgttacggtagataccggagccggaataccagcgggagttcggctgctcgctattatccgccttcactacaattacgttcggttggcttccatacctcaaataaggcgtcaagtcataacgaaacgatacataaccattcgggcggaatcccagcgaatgaccattgatccaaacctcgctattccggtaaaccccgtcgaaatcaacataaacaaccttaccccgatccgtctccggaagggtaaatgtctttcgataccagccaatcccgcccggtagcgcaccgccgcccggggtagacgggttatcgagggagaaatccccctcgatactccaatcatgcggtaaagataagatacgccaagtggaatcatcgctgtccggggatgaataatcctgaacgctatccgacaaggcaaatttccaatcgtcattccatgagctacgttcacgcacctgctccccggtgggggaacaggcggtgagcaataggcccagaagccacgcgaatggccgattcatcagtgatatcattagtgattatatagtttaattgatattacccagttgtagagacggggcgtgccctgtctctacaactagaggtttaccttggtaagatattgtcacgtccttgccagcggggttctccggcgtgatgagacgtaccgtgatctgacgctcgcggatcatgcccggataatcgccctcccgcgcgccgatcgtgagcgttcgcctcgcatcatcataaacaaacgggatggtagcgtaatttcctttctcgtaatcgtaggtcacgccattatcctcatataaggtgaaggagccgtcggcaccggcgtaaacagagacggttaagtctttctgctcctctttcgtagactggattacctttccggtcggtacgatagaaccggctctcacgaacaaaggcatacgctcgtaaggagcatccacgtccattgtcgttccgccttgcacaggcttgccgttgtaaaaatcgtaccaaatgccggccgggaagtacacctcacggtcgcgagccttatactcatacaccgggcatgccatgaaggccgggccaaacataaactggtcgtctatatcgtaagtcttctcatcgtccgaataatccatcaccatggcacgcatgatcgtataatcctcaaaatgcgtcttggaggccaagctatagatatacggcatcaattgataacgcaactcggtataatacttcatcgattggtacgtaggcgatccttccggagcgatattatagatctcgcggcaaggatattgcccgtggctacggaacaacggacagaaagctccgaactgataccaacggttgttcaactccctccattccctcaaatcctcgctaccttccttagcagccatataacggttctccacgctgaagccaccgatatccatcgtccagtaagggataccggacatggcgaagttcaagccggcgctgatctgcgctttcatatcctcccagcgagtaccgatatcaccactccatgtagcggtagagtaacgttgctggccggcgaaaccggaacgggtcaacaagaatacacggtcatccgggtttacgctacgttgtccgtcgtagatcgcctcggcgttctccaaggcatacgcgttgaagtatttcgtggacgggcccagataagtcggtccgcaaagcgccttccggtattcgatgtccgtattatcctgtacgttcggctcggaagcgtccatccaccaagcgtcaatgcccaaggaatacagatgctcgttcatctgttcccagaaaagcttgcgggcttccgggttgtacgcatcatagaaagaaccgatataacccggataaatccagtcgcggatactatccttaatcgcctgctgatacatggcacccagcgcgtccaactctttataatgctctgtcgtataataaaacttcggccatacggagatcatgatacgggcatccttatcgtggatttcccgaatcatgcctttcgggtccgggaagcgttccttatcaaactcatggctgccccacgcatctaccggccaatagctccagtcctgtacgatcacatccaaggggacctgccgccggcggtactcgtccaaggcacccagtagctcctcttgcgtcttataacgctcgcggctcaaccagaatcccatcgcccatttcggcatgatctggctcttgcccgtaaccgtacggtaaccgctgatcaccttatccatggaagactctccattgatgaagtagtaatcgatatcatcccccatttccgaccagaaagccaaccgctcccgctcctcctccggtaacggagataataccttcaagccgatataagagacatcgccatccggcaaccattcgatacggatcggataacgtttgcccttttccagatgagccgtggctttataatcattcgggttccaagccgcacgccagcgttccgggatgatctccttattatccacaaagaccttggtataaccggcgtaatgcagtttgaaatggtacgtaccggtctcctttgcctcgatctcgccctcccaagtagcggaagcgctcggcttcgggaagtctgccggcaggttcttgatggttttcagattctcataatccaccttatcctcatcccgtcggattaaaacggaatgcttcgtcttatccgtatagtaagtagcggtcaacgcccctgccttcccgtctttcccgtataggccaaagacatcgcccaaatcggcgtatggacgcttgtcgccgaaacgactcaaggaatagttatgccaaagtacaccatacccttttgaggaaacgataaacggcacgctcaccttcgtgttatattggaaaagctcctcgttcttgcctttgtagttgaactcatcgctctgatgctgtcctaggccgtaaagcccttcctcgtcctcgctctcaaatacctgacataaggtatagcctttggttccttccacctcgatcggcgtaaactccttgccgccgtttgccttctcccgaaggatcgtgcgtccgttggcgtcggtaaaacgaacctctccggtctcccgggaaagacgggcctgtgtggtttgcgtacttacgatgatcgtatcccccgaggtcgttatctgaaacgatggggcgggcaacgatttcgtgtctttgatcaagttcacttggttggaaaacttaccatccggagaggcgattacccggataatatcatcagagattacttccaatttgacagccttcgcctgtccggaacggatatcggcgaccaagccattctcgaccttccggtaagcggaatcagtcatgcaggaagtcagcagggaaagccctaacgtgaataccgcgatgtgttgtttcatattctatagattctttaattatttccgatcagcaatgacttcgaacaggtttttccatacaagaaaaatggttcttcattcgttggcaaaattaaagggttcgcggcggacaggaagccataaatgttttgggttacggggagaaccgtaaaaaggtaggggaagaatgtttattttaaggggatattttgttatatcccctaattacgtggcatttatttagaaaaagtttatttatgatagtcagagggaagccttccgaactcatccttaaaatacttccggaatagcttcacatcattgaaaccgcactccagcgcaacctcgttgacccgcatctggctcttctccaataactgtgccgcacgcttcaagcgcaccgtacggatcaactccaccggagtcttacccgtgatggaaaggcatttcttgtagaagttcacacgactcatgcccatctcccggctcaaccgttctacagacaactccggattggcgatctgctcctcgatatagccgatggccttacgcatcaactcctcatccatggagctagcttgtacttccgtcaaggcgatgcccatggtagaggactgcataaaggccttttgcatcttcttcttcatctcgatcaaatgccgcaccttcaagagaagcatctccatattgaatggcttgctgatataatcatccgcaccggcttccagaccgaccagttggctatcttttgcggacttagccgtcaacaggatcaccgggatgtgggaagtccgaatgtctcccttgatccggcggcataaagtaataccgtcggtgataggcatcatcacgtcgctgatcaccatatccggcagctcctccggaatgagtttccacgcatcttctccatccgccgccgtgagtaccgaataaacgccactcaagcttaacttcataaattcccggaaatccgtgttatcgtctacgaccagcaacgtaggtctttccgccggagacgcatccttatcagcgatctccggatgctcctcaaccggaggcaagatatccccttcggcaattccttccggagccgagataatatcttggttgtccaaggggatcaccggcagcgtaaccgtaaacgtactacccgctcccggctcgcttttcacggttatcgtcccatgatgcatccgcacgaattcccggcataggtgcaggccgatacccgtacctaccacgggatttcccttatccggggaagccacctgataaaagcgatcgaagatagctccttgtttatccgcaggaataccgataccgctatccgacacctcgataaccagtttgttctctccctccttctccaaccgcaatctaagcgtcaccgagatagtacctccctccggcgtaaacttaaaagcgttactcagtagattagagacgatcttgaagaccttatccgtgtcaaacttcatcgggagagacgtgaagaccgaggaaaaagagaaatgaatccgcttttgctccgaaagctccttgaaggaataagccacgtcacgcacaaacgggacaatatcgccggtagacaagaccaagctatccccttgcatatcgatcttgcggaaatccaataactggttcaccaatttaagcaaccggtcggcgttccgatagatcaacttcaatatttgctgggattccatgtctttctccgttttcatcaacttctccaaaggagtcatgatcaatgttagcggcgtacggaactcatggcttacgttcgtaaagaaacgaagcttcatctcgtccacctcatgctgctgacgcacagtagcccgttcttgctcctcctccaacttcttttgctggatacggaaaataaaacgtatcacgccatacgccaataatataccagctatgatatacaacgctattgcccatccggtagcccagaacggaggcaggatcgtgatctgcaagctcgtgatctccttgctccaaatccggtcgttattcatcgcctttaccttgaaagtgtaagttcccgggttcaagttcgtataggtaatacgacgttccaaggcgcttacggtagtccattccgagtcgaagccctccatcttaaaagcatatttattcttcaaaggaaggaaatagcaacaagaagagatggtaaaggagaaattacgttccgtataattcagtttcaattgcttggtacaggtgatatctttatccaaaatcacatgcccgtcatacgcctctctcgccgttatcgggacattattcaccataagtccggttatcaccgccggtggagcatagctattataacgtatccgggcaggctcaacgaaggtaagaccgtttgtcccaccaaacgccaactcacccgtttccagcccacaagcgctattcacattaaacacacgtccttgaacgccctcattctcatcatagctattccaatcgaacgtataattattatccgtatcccgattcggaacgatattcaataagccgttcttcgtccccacccaaaccgtatgatatttatcctccaagatagacatgatgctgttatccggtaatccggaagaatggttcaaccgatacatcttatcattcaacctatcatatatatgtagcccatgattactcccgatccatacccattggcggctatcacaaaatacgacattgatgatttgatcctcaaacacggaacgtccatccttcgtgccgttaaaagaagtaacagcccccgtctccgggttgatccagttcactcctaaagaagttccaacgacaatattccccttctcatccccggaaaggctatatacgatatccgagttaatcgcattctccttatcccccatgcgataatacgtccatttcccggtagattgatccaagcaatccaggccgccttccaacgtaccgatccacaaacgattcttggcatcgacatacaaactatacacgctattattggataagccgtccttactgcccgggatatcccgataatgcttgaaacgtttcccgtcaaaaccggtcaacccctccatataagtacccagccataacttgccatccaaatctttcgccatactaatcacgacatcgccggagatagcgttctcgctttcccgtcccgcccggtagcggacatactccccggtttcccgatcgtaacgtaataggccgtttccgctagtaccgatccacagatccccttctttatcttctacgatacaattaaagtcattgttaaagatatcccgcatcaactccaaagggtaccggatagtctggaatttaaaaatgctctcatgataatagttgatgccgtttttataagtgccggcccacataatccccgtatcatcccgatacaagcagatcacgctattctggctcaaactcgtttggttaaacgggttatttcgtatataacgcatccggttcagacgtttatccaagatattgataccgccatgatcggtagcgatccagatattaccgttcatatcctccgccacgtcacgcaccattatagaggataaagcgaccgaggtttcggtcgtataatgtttccactccttgcttttgggatttaggcgaaagagacctctactatatccgggatttaagaaaaaccacagatccccgtcactatcggcgaacacatagaataactgggcattcgcatattgagtcagatactcatcccgatagacagattctccggatgctttatcgatcccctctaccactcccgaggtatggactacatatagacgatcgcccacgtcactcatatcacaaacccggccatcctctttatttagtggatacgaataaatctttcccctcgcttgatcataacgacaaaattcattcgtataggtagcgaaatagagttgtttatcattgtcgacgaatatcttagcgggaggattctctagacgtaagctatctaatatttccttctccggaataaaacggtcattaccgggctcatatacgcaaagttggttcgtattataggtaatccaaatacgcccatcagcggtttcttgaagttcggagacatgctcctccctaaaaggcaacccgctttccttgtatttataatgcttaaactcatacccatcaaaacggtttaccccagaagtggtacccaaccacataaaccccttccggtctttcaggatacaagtgatctcattggaagacagaccgtcctgtactcccagacggttgaaaagaatatcttccgccgcaagtccggatcccaatattccccaagacaggatcattatgatacagagtagagttttcgttttcatacttagcaaatatagatatttcccgaaaacgaaccaaaccaaccggtatctaattctgctgcaatgcgggttgcagtaaacatacacgtaaagtatccatatataagaacatgattattaaaaattatcccgtacatttgtctttcgattggaatagaaatgaataaggcgcaatgattgttgtaagagattttgacagactgaaaggaaaggaactggtggctacgatcggatttttcgatggtgtgcatctaggacaccgtttcttaatcgacgagatgaaagagattgccaaagcacgtaacctgccatcggccgtaatcaccttcccggaacatccccgggccgtattgcatgcggattaccaaccgaagctattaaattcttccgaggaaaagttacagcaattagagactaccggagtagattattgcatcgtattggattttacgatcgagctatcccggctctcggccaaggaattcattacctctattttagcgaagagcctgcatgtaaagaccttattgatcggatatgaccatcgtttcgggcacgatcggacggatggcttcgagcaatatgtcgtttatggcaccgaatgtggtatcgaggtgctgaaggcatctccctatgacgaaggaaatacggccgtcagctcttccgaaatccggaaattacttcaagccggaaatgtagctgaagccgcttatttactgacctatccctatcaattgctgggccatatcgtcagtggctataaagtgggacgcacgctaggatttcccacggcgaatatacgggtagatgaaccttttaaagtcattccgggtattggcgtatatgccgtatgggtggaggtggaaggcgaacgatataagggaatgctttatatcggtgaccgtccgacactcaataatgggaaggacatatccatggaggtcaatattctggatttctccggagatatctacaatgatagcattcgtgtctcattcgttcaatacgtacgcggagacatcaaattcgattccttagaagaattgaaagcccaactggagaaagacagatgcaccgtaaataatttattataatatggaaagatattacgaagcgattgatttattaaaaggcatgatctcccgtccgtctttcagccgggacgagaccgccgtagcggatttcctgcaagcagaatggcaaaaggccggacaaaaggtgttccgcaaaggcaacaacctgtggatcatcgccccggatttcgatttcggtaaaccgacccttttactcaactcccatatagacaccgtcaagcccgcttccggttggaccaaagacccgttcactcccgaagagaccgaggatgatcaattatatggactgggcagtaacgatgccggggcgagcgtagtctccctctatgaagccttctgtatcttaagcgagaaagaacaaccttataatctaatcttccttgcgtcttgtgaggaagaggtatccgggaagaatggcattgaaagcgcattggccgagcttcctcctatctccttcgctgtcgtaggtgaacctacgggtatgcaacccgccgtagccgagaaagggctaatggtactggattgcaccgctatcggaaaggccggacatgccgcacgtaatgagggcatcaatgccatcactttagcgatgaaggatatagaatggttcagcacctatcaattcccggagaaaagcgacttcctcggaccggtgaaaatgactgtcaccatcatccatgccggtacacaacacaatgtcgttcccaataaatgcgaattcacggtagatatccgcaccaacgaattttatacgaacgaacagttattcgagctaatcaaggaaaaggttcattgcgagatcaaggcccgcagcttccgccttagctccacccgcacggatctggatcatccttttgtgcgacgggcgatcttgatgggaaaagagcctttcggctctcctacgcttagcgaccaagccttgatgcgtttcccctccgtaaagataggaccgggaaactcggcacgttcccattccgcagacgaatacatcaagggaccggagatccgggaagcgatcgatacctatgtaaggttactgaatggattacaactatagcttatgttaaaaaagatactggggacaataggctcgcgttatctgatagctttccttaacctagcgctgatcttcattaatgcgaaggtgctgggaatcgagggcgtggggatgatcgggttgatcgtggcctcggtaaatatagcggtaatcgtcaatgggattttatgcgggaatacgattgtctatttcatgaatcgttactccatgcggacaattttccttcccgcatatctgtggacacctatcggctcttccctagcttgcggcttcatgtatcttaccgggcttttacccaccggctatcggctggatatcttcttgttggcgatcttgagctctacggtaaacgccaatgcccgcttcttgttgggtaaagacaatatcaaagggtttaatctcacgtttatattgcaaggaggactgctatttttcgtcttactctatttctattatatattgaagcgcccggacgtacggtcgtatgtctggggattatatgtcacgaacggcatagcctttattgccagcctatcgatgcttgttccttatttcttaaaggagacatcccggtcttccggcaaatcactctacggtctattaaaagaaatgtttgcctacggcctgtgggccggtgcggacgggttggcggaaacctgtactacccgactcaattatttcttgatacaacgtttcgccgggttgggaagcgtaggcttgctagatgctgggaccaagatctccgagagtgtatggaatattagtcgcagcgtaagtttcatcgaatacagtagcgtggccaagacctcagaggcaacggaacaaaaacgtattaccttacagcttttcaaattgaccttttgcgctttagccctcgtgatgggatgtatcctattggtaccggaatggatatatacggattatcttttcagcgccgagttcaaaggcatacgtaaagtgataggcggattatcgatcggaatcgtagcgttaggctgcaacagcatcatcagccattatttcatcggcagcggaaagatccggtacagtacggcaagctcgtgcgtagggcttattgccttattaatctccggctttttactcatcccgtcttacggggtcgtaggttccgctatcacgaccagtatcgcctttacctctatgctggttttctcattgacggtcttctcccggcaaacacttacacgctggaatgagttccttccgaacaaaaaagacttccaagcttgcagaattcatatacaaaaatccttgtaattctatcacgaattttatcgataacgccatcaagttcacggaaaaggggacaattacgcttgaaatgatttcgtgcaagatacaggtctcgggttatcaaaacatggactgtaccttataaacaaactccatccaaacccaataacggatcgcttttcctaagaacatggagatcgccacgacccatatattagcccgcaagaaacctagagcgacagcgataaaatcaccgataccgggaagaaaaacaaagaagcccatccaagagccttttcccttgatccaatcctgcaccttctgtagttttaccggatcgagtttgaggtatttctcgatccactctacctttcccagcatccccagccaatagcagctcattccacctaagaaattaccaagcgtagcagcgatcatgcaaggccaatatgccgaacccgccaataatacacccgtcaatacgacctcgctgctaaacggtaagatcgtggccgctaagaaagaggcgataaacaccccgatatacccgtaggctataagaaattccatatacgtatcattaataatgcgataaacataactaccgagaaatggaacagccaaaagatatatttcccccggttcaccgtaaaaaaatgggcgatcaggatagacgccggtacacaggccatttccagaaattcctcggacgactgctcatagataaagaacaatccaaacgaccaaatggccatgacaatcagaaaagaaagaaactgacgagtacgcaaattatcctcatactcatgtgtaacgatgtttaatgaagcaatgatcgttaatcccgccactaaaacaatctgtatccaatctataattcccgtccctagtaccgcaaggaaacggatcttgaataaggaggtgaaaggtatggtaaataccgtgaaatcccattcccagacacaccatccgaaaacaaaccaataaaccgtcaagattccgaacaaggaagcgacaaatgtccggatattcaatgtcctgaaattatacattcccaaccaaaacagcggcaagaaccaaaggatgtgtatccacaacagacttccgatactgataatcaaggatgcgttataagccttatccgtagcgtccgggtcatgataagaggtaaataactgataaagggccaatatcaaacaaaacaccccgacagatgttgatttcaagggaaagaaatccgggtttgtacttgtcaacaaggcatagaagagaaagggaagcaatgtcttctcacgaatcaacatcaacgcatagtttacccgatgcaccagaaacgcaccaccggccatcagcaaaaaaccgatcaaataggtaaacaacttacccggaagaaccagacagagggcattccataaaggaggagccgtcacctctccatacacgggatagcctaccgaatccacataccccacgatccaacaaaaaatacaagcgcaaagcatgtacaaatgggtcataggtgtcgctatagtatatctacgtccgtaatatgaagttgttcctcttgccataatcttatcttagtgtgaaaatacggtacctgcgttagtgcaagcaccggagcgacgttcgtagtgaacgccgaccggtactcaccgtaaacgccgactgacgttcactgcaaatgccgaccggcgttctcgataaacgcaattataaatcaaacccgatatcccgacggaaatacttcttatcgaaatcgatctgcttagctccggcgaaagattgggccaaagcctcttccttagtagccccatacgaactgaccgcgatcacacggccgccattcgtcaggatctggccgtctaccagcttcgttccggcatggaacactatattgttcgaggatacgccatccaatcccgtgattaccttattcttctcgtaagcctccgggtaaccgccgcttaccaacataaccgtaaccgccgcacgagggtcctgtaccaatgtacgagccgctaaatcgccttccgctaccccttccagcaaatcaaccaaatcgctttggatacgaagcatgactacctctgtctccggatcgcccatacgacaattgtattctatcaccatcggctcattcttcacattgatcagacccaagaagatgaaacctttataatcgatatgctccgctttcaatccctctacggtaggacggataatacgctcgtccaccttcgccataaatacctcatccgcaaaaggaaccggggaaacggctcccatgccaccggtattcaagcccgtattgccctcgccgatacgcttataatctttcgctaccggaagcaccttgtaatcgttgccatccgtcaagacgaatacggagcattcgataccatccaagaactcctcgatcacgaccgtcttgctcgcgtcgccaaacattccgcccagcatatctcccaactctttcttggcttcctccaagttatcgataatcagtacccctttaccggcagccaatccatccgctttcaatacataaggagcggaaagagattccaagaacgcatagccttcctctaggttttcagtggaaatactcttataacgagcggtcgggatatgatgacgcatcataaacgccttggcgaaatccttgctaccttccaattgggcaccttccccactcgggccgatcacggggatggagcttaatgcctcatccttcttgaaataatcataaacacccttcaccaatggatcctcgggacctaccacgaccatattcacttggttcgccaacgcaaaatccttgatagcggcaaaatcatccgctttaatatccacattggttcctaccaacgctgttcccgcattaccgggagcgataaataacttatcaactttcgggctttgagcgatcttccaagcgatcgcatgctcacgcccaccagagcctaataacaatatattcatatctcttctaattttcaattctcaattctccattttcaattcccaaggtagtcatcgaaatacctcgtaatcttctcatgcaaatgcggacggtccttaccggtcacattatgctcatggcgaggatacacaaagtaatccggatacgtatcagcctctacgcaagcctttaagaaaccaaggctgtgttgccacactaccaccggatcgatatccccatgtatcatcaacagatggcctttcagattaccggccttcagttttaggttcgcgttcttataaccttccggattatcctgcgggcgatccatataacgctcgccatacataatctcgtaattgctccagtcgataaccggccctccggccacgcccaccttaaagatctccggataagtcagcatcaagttcgttgtcataaaaccgccataactccagccatgtaccccgatacggtcggcatccacataagacaaagatttcaggaactcgacacccttcacttggtccgccatctcattgatacccaaattacgatgaatcacgctctcaaaagcatgtccacgatttgccgagccgcggctatccacggtaaacatcacataacctctctgtgccatatagaggtcccaaccacgagccccgttttgccagtcgcccgtaacaagctgtactttagggcctccatatacatagacaatcgtaggatacttcttcgtctcatccaaatccggcggtaaagtcaaccggtaattcaagcgagtcttaccatcggcagcaaggatatgtccaaccttgatccgcggcatccgatacgatttaaagggatccggagcagaaagtaaggtagaaatcaccttagcgtcctttatacggactaaatcgatatccctcggggtagaaggagaacttacataatcaatcgcatattcgccggagggactcagcaaccaacggtgcacgcccactttccaactcaagcaattcatgatatcacccgttctcaaatccgtctcccaaatataacgttgcatccccgttccttgcatattcggagatacgggatgaggtgccgttccctcgaaaatcaccttatttccgtctttgctaaagcctagcaccttggtaaccacccattccccaccggttagcttccttaattcctttccagtcgtatcatacagatatagatggttatagccatccgcctcactctgccagataaacttatccggatcgttcggcaagaaaagcacgggatgctgcggctccacataacaacgatccgtctcggtaaacagatcagcctctttctttcccgtcaaggcagagtaccgcaccaaatgcatctcgttctgctcacgattcaactcagcgatataaatactcttctcatccggactccaagcgatatttgttaaatatttctctttcggcaagcctgtctccaaccaaaccgtctgcccggtagctacctgatagacacccaccgtaacctcatggctcttcattccagccatcggatatttatgaggaaccggcgtagcgcaacgagtatcgatattcaccagcgggtaagcggtcaccatacgctcatccatacgataaaacgctagagccgagcctttaggagaccaaaacatacctttcgtaatcccgaactcccgttgatggacagcctgtccgcatacgattccatcctgtgtttcacgtgtaacaatcgtatttcgtccatccggggataaaatatgcacattgtttccctccgtaaaagctaagttattcgtagccgggcaaaagtcataattcgcccagttattcttcaaagcataatcagcgactaccttattcttcttatagtcataatgaatccggtgctgtttgctagtaaaagccaagaccgaacctctttcatagggtaccgaaaagctaggcaaggaaccaaccgtctgcagatttgccgccgtcaaggccccattcagtctttccaacgaaaaaaggacctcttcttttttccccggcttagctcctaacacgctatctcccttaacatataagtactcgtccccgcaccatcgtaactgtttcaagtcacgaggtacgaagcggctatacgtcttccctccaggaatcaagtcgtgcaaggagagttgcttatcttgggcggtaatcgacatcgttaataaaatcagacataggcttatgaataaagatgatttaatcctcataatcatcataccctctccgttttataggctttataggtttgctaaatgggcgctttccatccctcttatgatcgccaaaccctttcttacggtcatcctcatcccgataacgcattttcacaggacgttctccttttggcttgatcggcttacgaaccggggcatccacgaatttcttgcggaccggacggtcctctccccgatcctctccaaagatacgtttccccggaatggaagcgaaacgctcctcatcatcctcgctatgggcagcggcgaaacgacgctccggacgatccacacgacccgtacggaagtttggacgatcattgcctctacgttcgaaagagccttccgatctgtgcggacgctcctttccatcctcattcaatgcctttttgaagtccttattggttccctcaaataactcatagcaacggtattcgcactccaaggaaccattcatcaatttgatcttctcgctcgggcgcaagccgatcttatcgaaacattcatctttatagctcaaaatccaagccttatatcccatgaacacatgtttcaaacgctcgccgatcatattatacaatcccaatagatcacgagatgatatacgctctccataaggtgggttcgtcaccaatatacccggcttcggagcctctgtatattgttggaacggtttcaccttcagatcgatatatttcatcaagccagcgctacggatattctccaaggcgatatcgatagcggcttgggaaatatcggagccatagcaatggaaagcgaactcacgctccccgctctcatcattataaatacgatcgaacaattcctcatcatagtccacccatttctggaaagcgaactctttccgatggatacccggagcgatattcaaggcgatcatggcagcctcgatcaacaatgtaccggaaccacacatcggatctacgaaattagattctcctttccaaccggtttttaggatcatgccggcagccaacacctcattcaacggagcttccgtttgatccacccgataaccacgcttgtgcaaagactcgccggagctatcgatagataaggtacaatcgttatgcgaaatatggatattgatatataagtccgggttattgacacgaacggacggacgcttcttgaacttctcgatgaaataatccacgatagcgtctttcgtacggtaagcgacaaacttcgagtgattgaaatcctcggaatagatcaccgagtcgatcgcgaacgtcttgtccagcgacaaatacttctcccactctacctttttcacctctttataaacggtatcagcatctttggccttgaaatgataaatcggtttcagaatgcgcagggcagtacggcagtggaaattcgctttataaagcaattccttatcacccgtaaaggaaaccatacgacgaccgatctgcaagtcgttggcacctaaagctaataactcctcggccaagatctcttccaacccgtatagggttttggccaccatttcaaatgtctcgctcattttaattgaaaattgagaattgagaattgaaaattattcccaattgcgtattacgttgtttattattaattattctcatttcgctctctgacatgcttcgatctccttccagctaccctcttgataattttcaattctcaattttcaattgtgtaaccgtactccctgccggtacatcctccgctatccagacgttaccacatatcgtagcccctctgccaatccggattttaccgattaaggtggaattagaatatactgtcacatgatcttccaagataggatgacgggctacgccacggatagcgttaccgttctcatcggggggaagtttctctcccgccaagctgacgccctgaaagattcggacgtaattgccgatcacgctcgtctcgccgatcaccgtacccgtcccgtggtctatcgagaaatgatgaccgatcttcgcgcccggatggatatcgataccggtctcggaatgtgccatctccgtaatcatacgaggaatataaggaaccccgagcttatacaattgatgggcgatccggtaattaccgatcgcccggaaaccgggataacaaaatatgacctcacctagattttgagcggcgggatcgccattgaaagtcgcctccacatccgtagccagcagaccgcgaatctccggaagcgtagagatgaaagcctccgaaatagcctctgcctcagcggagatcttttcttccgggcaagtcacgcaagatgtatccgcgaaacaaagtcccgcataaacctgcttggataataaagaatgaagagtctcaacatttacgcccgtatgaaaacggatcgtctgtttactgatacgggcattcccataataaccggggaacaggatcgcacggcatagatcgatgatctctttcagcacctcgcccgagggcaacgcctcctcatccctgtacgcatggaacaattgtttatacgatgcctcatccgatagcttctccaccgtatcgcccaatacgctactatgcctctgtatatccattatttgcggaatattctttataatgcgcaaaaatagtattttatttgagaacaccttcacgaagaggcatcaaaaatacagccaacgactaatattacgttctatagcgctaaattccacgccaacctttatcaacttacgcccatccgcctgatagagttacaaataaataatcttcatatcgaatactttaccacatccaatgctccactttcatcaagagccaaggcgaccagaaaacgatcggaagggtctacggcaatcctctttattgaacgatcaaaattcaatcgtttctttaattggccgtcccaagaaagaaccagcaatgtggataaattcgaaaaatccgcagaaccatcgtacaagcaatatacatactgatccgtaccgaatatatcgataaagcattttgtcgttccaagaacatccacttgggtatcattcttcttcagtaaaggcacgataggctccttcccatacgtaaagctcctttgataagttcccttcaaatcgtaaaaatcaatttggttgaagaaacgcaaggcagcaaccacactgttttgccgctcattcacacaaagattaggcaaataagcgacgtgcttacaagaacgatacgttcttgctacttttggtggctccacccaataaattccctcttcccgattcgcatagcagaaaggaccataaacatttttctctacgatcggaaccgcataaacttctttcgtggtgacattataatgcgtagagggaacaagttcgggtattagtatatatttccgatcaaaacgcaaagaatccgccagcacctgcatcttattaaatgtaagttggttatccacgatccagaactcatcctttccggcgggttcttttgtatttgacttcataaactccggattagagaaataagtggcaccatatcctttcaacgcaaacgcatgcaggtgcgacaaatcatctttgtcgaatacttgaatgatcgtatcacacccacgagccaacaacaccaaataagactcggtaagaccaatcccatcatagcatacaccagaatcccctttcattaacaaatttccctccagccgtttttcttctctttccgcatcggaacaagcgagaagaaacaaagcgaagaatacaataatcccatacaatactctcatgacctttctattttagatttttattggtttgactcaaccgattgaagaataaacttttagcgaattatttgagaaatagaggtaacgagttggcaaccgtgcgaatttcagcgttttgcgttgctgtgctgtcaaataactctttttattacaaaagtacgaattattttctacaatgcaaattcctaaaggtaatgttcgtatatcggggacttcctcttccataattatttgttttgcattgaaaccctgtcatctaccgaagaaataagcagagaataaatgctatccaaaagattctcatttatgccgaaacaacgcaagatagttttatcaaaatttattcggtcggcttttcgcacttccttaaatattgattctatttcgcggtgttttaagggttgaaatgctactaaaacatctgatttctgcgcatcattaagtaaatcaggatttaatactttcagttgttttagataattagcgtttagatctaatgcgcctaaattgcgtgaagtgcctcgcatttcgagtgttaagaatgtaatagcagaattgaataaggcggcaattagctcaacatcataaccgtcttgtacacacatggcaatcaaacgttggtctatcgtaaatggtgtttgcgagaaggtgaaaaagaaacgttcaaacggatttattgctgttatgatacttgcttgtttggggcgaagtgaataccaataagggcggtgtccggcacaagcctgttgtattgtttggctgccatttttgttttgtgtgtttgcaaaacgttgaatccacgactttgcaccattgggcaaattgtctatttcatctggacaaacgaataatcgaaattgatagttttcatcaaactctattcgttctaattctgttgggctttttacatacggcaaaagatattggttttctattcctgaagatgcaacatctctttcgggtattacaaacatttcattccaacctgtacgttctccacgaaaaacatttataacattaggatataattgttttaacgaactgtcgaaactttcaaataggttagcagaaataaaatactttgcccaattatccttgtcggttatggactgtaataatttatgtttaggaacaatacaaacagaaatacggtcttgctgatttaagtataaatcgttgaaagttgaatctttattccacttattattgtgggtatcatcgcaattgtctatttcagtataaaaatcttctatttgttgtatttgacttgctgtattatcctgagaaaaatagtctttcaacttaaaatcaatagttacaaatcttgtaggttcttcatttgcccctttttgaaataccgcataaacggtagaaacttgagaatcagaaaaccaatgttcggcatagcttttcactacatatttgatatgaaagttgtctagtaaaaatttcttgaactgaaatccatattctttaccaagccaagcatttgaagttattatagataaaacgccgccatcttttaaaaagcggaatgagttgtacacacaataagtaaaataatcagaacgttcattgattttgaatgttttatctttaagaaatgcttgttgctgtgcttgaaactcgcctctgaaaaagttggttaaaacatcatttggaatatcttcttgctgaataaatgggaaattacttgcaataccatcaaattgaggtatagctaattcaatgtgtttcttgtaatcttttgaatcgggaaaacttactttgttacctacattcagattaaaaaaatcgtcacgagtaacacgaggaaaattatccgtttgtgttacatcttgtttgtacaaattgataaccgaaagaatggtgggaaaatgtgaaacatcgttaccccaaatgtgattcagtaagtctgaatgattggtatttccatgaaacgccataatcttgtaaaaagcgttcaagaatgtacctgttcccgaagtcgggtcaaacaaattatcttggttagtttgtacggcagggaaagccacaagattagccaaagtttcaggtgtaaagtactgaccgaatttttgcttttcctctttgggtacaaggttttcaagaatatttccgattacagcagtcggcaatattctaaaatcaaaatcagtaaaaatatgaattaagtcaaataaagccttgtttgttgtggcagaataacttatatcgtctgtaaaataaggtttaaaaattgcctgataatcaattgcttttgcttggtcaaaatatgagaaaagtgttgattttaaattggaaacatctgttattgtaatattttccaattcgccacttaaattttcgcataaagtgaggtaaaaaagggtttttccaatcaaattataaaaagtaaatttcgctaaaatttgttcaggtacaaccgtttctgcacgacgggaagaagaagctaaaattttcaatgttgaactttcataaattttccattgattgaactcctttctaaaatcagcattgcttcccttacattcatttattgccttttgaaattgaggaataattatattggaagcactacggactgcttcaataatatttcccgtaatatttatggcaggctttaactctcctgtcgtgtataattgcccaaggtcgtgcaaaatttcatttgcccgttgctttaataatgtctcgttgtgggcaaactttacaggatctgcaaggtcatcacgggttgaaatagaacgttctttttgatattccttaattttactaagtgtatctatggaataattatcggtgtctattttccaaatcacagcttccgtgccgttccatgttacgaatgaatcggattgcaacttcttcgccttttccaacgcattgtcaagcattacggcatcatcaacagcagtatcaggaaatttaagttcccagccattgaaaataataccagatactttgtcggtaaataacagaacatctggaaatttagttcttcctgattccattttaacacctgtatcgtttgtggcatcttcaaatacagttgtgccgtgttctatggctgattttatccaacttataagttgcccagcccaatctctttcattcctctttattgtattagtcgccataattatttagcagtggttaatgctgttgttgtgtgattatcaaacgatccatattcagtaacagtagccaattttgaacgtaaaatttcatttattctatcgttgcaaacttttatataatcaatagactttgttttatgaagtaagacatttttgtttttttctatgcctatataattacggtgttctaatgctgctgctactaaaaaactaccactaccgcaagcattgtctaatatagtatcgcccggattgctgaatgtgcgaataagataacgtcctaattcaacaggcttttgtgtagggtgataaacttttccctctgattccgctgttttaaaatacacgaaatcctcaatattttgttcttcataacaaactacatcattagggtagcgttgtccgttactttgaacatggcggggcttaaaatcgccatagctgcctgtgtattggtctttgcggatgcctttgtcataactttcgccctttgtcatttggggattgtatgtaggttgatttttataaaacacacaaatatcctcatgtttgcgaagtggttgtttcttagcattgagaaagtttgtcgatttcgattttatccatacgattttatatttgaaccaactttcgttgcttattattagtttagcagtaaacagaccttgcgcagttaaaacaatagctccgttatccttaataattcgagtatattccgcccaaagtttttttaggtctattactgaatcccatttattttgcgttgtaccataaggcaaatcgcaaagaatcatatcaatggacttgtcggggatatttggcataatttccaaacaatcaccttgtattacttggtttatatatttatttttttccatattcaaccatattttcttgtactacatttagaactttgttggcgttattttcaccttttaccacagtgtaaacttggtcggcaagccaaagagtaagcagttcttcttggtcgactttgagtatttcggcaagtttaacgacctgttcacgtttggctcggcgttcaccacgttctattttgctgtatagaccattgtcgatttcgagagcagcggacagttgtcgttgcaacaagttgttttgctctcttagctgtttgattttatctgcaaacatcattggtaatcttttgacttgacaatttttgtacaaagatacaataatcttttgaggtatgggaatgtttgaacaaaaaagttttcaacattgtatgttcctatggggcagttttaatataactgccgtgcgccttttccatgtgcaatactacgaatcccatatcatatttcctttcttttttggcttgtgaaacattggtttaatctctctttgagggcggcaaatgccgccctcatggggtgtgcagaggggcttgccccttgccttattggggaattttcagcgatacgtagtattgcggctcggaaaattccctaataagctacggtattttccccgtaaataccctgcggcgtgccgtccgtctgtccgtctgcctttcggcggtggctgtccctgccgcctgcttgcccgtaacccccaccttattatttttccctttcggtcggtggtgggcggcggggcggtcgtttccgttttcaaaggctcttttgcacggggcggtcggatacaaggttttcccgataaatacgctcgcagcgaagcgagaggaagatttatcgggaaacggcgcagccgcctgaccttttagccgacataaagccccgtgcttgctttgcctttgtaaacggaaatgattgctccgctttcctctgaaaagaggaatagaacctgcaatataatatatcaccatagtgataggtttgcatgctggtatgctggtacgtttgtatgttggtatgttgatatgttggtatatcatcatgctttccaacggctgttgggcttgccgtccgaaacaaccgatacgaataccgtcgttttctcttttcgcccgtgtataatcctctctaataatgccctgcggactttcgccgccccgaacgactcgatacggaaagcgagggcggctatcgtttcgaggttgtaaacctcgatgtaacttctctccggtaagcggataaggcgttttatgccgtactctttcaaaactccgcttttgcagagtgcctttatccctgcccgaaccgtcggggcgataaccccgaacagttcgcagatttcccgcacggtcatggcggttgcacctatatcgctcggcagggagatattgccctgcccgtccatcgtgataatgttcctttcttctttcatcgggattctgtttttaattagatggctcggcagatattcttctccatatcctctaacttgtgcgacaaggtttccatgtcttggcttatcttctgggcggtgattttggcgtaaatttgggtggtttttatgttcgtgtgtcccaaaaggcggctcaccgtttcgatgggtacgccgtgcgacaaaagcacggtcgtggcgttcgtgtgtcttgcaacatggtaggtcaaacgcaccttgaaaccgcattgtctgcctatatctttgagtattttgttacaactgccgttgctcggaacggggaaaacatgaccgtcccgagccagtcccttgtatttctctatgatacgcttgggaacgtccaaaagacggatgttcgattcggtgttggtcttctttcttcgggtgattatccacaggttgccgtcgaagaatgtttgcaggcggtcggcggtgaggttcttcacgtcggaatacgccaaacccgtgaaaacagaaaagacgaacaagtcccgtacaagttcatgggtggcgttcttcatcggtgcgtccataagcgtctgtatctccgtttgggtgaggtagcccctatccacgctttcgggagagttgatatatccggcaaagggattaaagggcaaacgcccgtcgtttctcgctatcgaaacgatgtgtttcaacacaatcatgtagccccacacggtattggtgcggcatttcttctccgtgcgcagaaagtactcgaagtcgttgatgaacgtgaggttgagttcctttaacggaatatcctcacgcttgtaggtatggggcagaaactcccgaatatggttgcagaccgtccgataacgggtaaatgtcccttgcgccctgctgtgcccgacctttttggcgaactcggcgttgtgctgttcgaacagcttcagcaaggtttcctgcttgacgccgataccgagataggcatctttgagcttggcggcagtaacataaccgtccgtctgcatcagttcttggtagcggcggtttacctccacacggattttatctaccgcaaggttgattctctgcgcttcgatgctcttgcccgaagcacggctgttcttcacgtcccacaaccgtggggaaacgtccagcttgcaactgaactgtttaatctcgccgtccaccgtgatacggcacatcaaaggcaggttgccgttcggcttctcgctgcctttcttcacgtaaaataataccttgaatgtactacgcataactcactccttttttgggttacaaaattagttattagtgagttaccgacagctatgtgaaacaacgcaaaacgcagaaacagaaccttttagcaagaaatctgcacccgttacgggagtaacgaggtggtaactgaacttctgcaccgtttggcttcgaagtggtatttcgttggctctgccccatagaaaaacaaagcgtaacgaacgctctatcagctaattcgctacgctttgcccaaatttactttttcgttatgtgtttattttaaataaacataagatcggattatcgtcctgtgtacgattctccgctatccgtctcaaatcctcataatgtatctgattacgcaacagcaccgtcgaactgatcttcccgataaaataatctttatacactccgcaaataccgtaaaagcctgtcaaccccgtagcccttatgaagttggggaacgcatacgagaatgcctctttcctatccttgtcataaaatccgaagtaagttaccttatcgcacatataggtcgcatgcaggatctgttcggtctccagcagcccaaaagaatttacatagccggagcgaaacagatcgccagagaaatctctcccgcctctccctttctccttgacatactcgataggaggcatacttttatctccgaagcgaactttataagcaggctccaacatcccgtccttcactttccacacttcgggggtaaaggggaaatgcgcataccaatccccagcaaaggcatgcaacgtcttgctcccattgatcgtatggccggacgtgaaataagccggtcccaacaatgcgtcttgctctcctttcctgtccgtggctttcagatagaagttttccctttgcggtgtcgcaaatcccaaaggataataccaaatccaattctccttatccaaaggggcgcagtccacaaaataatcagctacatcttgcgtggatatatattgataggtatccagatcataacgcaataaggccgtcccaccaaaatccaccaatgtcaagattcgctctttctcatccacgaaaaagtgagttagataaagatactcttccggcccttgtccccgcaagcctacacgagtaataaaatttccttgatcactgaatacaaaaagcgcatttatctcatcacttctatcgaatacaaaaatacgatcgtccacccagcaaacccggtagagatcttttaacagcacgctatccttcgtctccaaaggaatgaatctgcattccaaatgttcctgcaagccaaccgtacaatcgtttccgaaatccaccacgtcccactcttccgatcgattctcgcatgcgatcaaaatggaagccagacttatcatcactaaataatatagttttctcatgtttttcatattagattcagaccactaatatacgtaactttttgaaatacgccaactgcacaagttttcctaagcgcacaatcggaattcacgagaagtactacttccttggcctatgaagtatatctcttagggatacagtgcttattttccacatagttattgtacatttttccaaatgcatttaaaacctcattatctgtttcccaaaacacgtacgtgttttcacaaattctcgtacatgtttccggaaaaacacgtacatgtttttccggaaacatcatcaactttttatcaatctgattataaagacattatcaatacgtatattttaaatacttactgtatttttcactatcaacaaaacaccttatggttatgatttttgaagccccaagaaggctttatttacgagcttatcgacttccttatacagccgttgtatttcctttgtatccaatccattttgttcccactccgtcttatgagcgtcgaataaatcgaaaatccggttctctaccgcacgaagctgttggatataaccagattggtcatcattccataacagttgccaatgcaaatacttttggccgttgccacgatgtatggagtagacattcttctgtaattgaacggaataccaatctaatagggctgttttataggatgcgtcgtaagtaactaaagcactttgctcctttcccattttcacccaaagaggaatagcgacagaggtaggaggatatcccaaggcagtccacatcgttgtcaattccggattcataccggattttacgccttggattacgatagaagccgtactttctagacgggggatgaaatcctgctccacaaaccagcctgtacgattgttcggactttgtcccttgtccatcaaatcgatatccagcaagctattataaaaagagcgggaagcctgctgaaagatacgctgaggagtaaatccttcgttccgcatttccttaaagatctttttcgcattctcataacgtacatatcctttgccttcatccgtacgcccctcgaaagagaaattcgtataaatcaagtaaccttccggcgccagattcggatcattcgcgtctttcttataatatcgctcattattcgtctcataataagccgcaccaccataagcatcgatcactccgaaattagcctccacacgcatcgggcgaggcaaggtatccaagaaatgctcgaaatcctgcaccgtcttacagactctcaaggcttttcgcatcaagtttccctcttgatccatctcctttatatcatcgtctttcaagttataagaagccgtattcatgatagagaagcccgtctcattgcttccggtccacacggctccctccggatcatcgctatttaccagccccagaaaacgataaccaccttcgtcaaaataaccgatatggttatacggagcgccggtatcccggtgtttccacatcaacggacggccatcgggagtagcctttccagtgattataatggaggtacaagccttgtcaaccaccggaaaacaaagacatagaacaaataaaagaagtagttttttcatatcatttattgatttaataagatttcttatgaggagcgccaaattccttacagctgacctcgtctatatctaccgtccaaatcttcacgttacggaccgccggatcgctataacggaaagtcttatcggaatattgcttcatgataatatccaaggcttccaccttcttgtcgaaatcctcttcgtaagcgacctttccccaagcgatcacgctcttcgaacgcatacggtagctacaagctacctccggatgctggaaaaccaaggcatggtcaatactaaacgtaatacagactttcggattacgttccaatatagagatgcttcgtccatcctgcgccgagtgtaaataaatcacgccatccttataaccgaaattcatcggcaatacataaggcgttccatctgtatccgccatgccaacgaagcaaacatcgctctggcggataatcgattcgatctgttccttgtccgtgtgtataagtgtcttcatattccttatgtttaaatctaacttgatgcaaaattaaaaaaatcatctgtttctgcaaccctttataacccgcactcgtctattaagaaaagaacctaaaaaattaaagacgatgaagacgagagtatcactttttatattctgcatacagatgatcgcggtttgcggattcgcagccgacaaacgtatcgatggaaatgggaacccggaaacccgggagataaagattagcgattacgacgagatcacgttcgttggctccgctgatttcgagtatgaacagtcggataaagcgccttatctatccgtaacgatcgatgagaacttatttgattacctcgtgaccgaagtagaaggcggtacgttaaagatctatccgaaatctatcaagaaaggttttaataataactcctacgacttgaggccgaccgtctacaagataaaatccaactccaaggaactaaaagagttgaatacggtaggttccggcagtttcattatcagcaaaccgacgaaagtaaaccggatggagatcaatatggccggtagtggaaacgttgagttgagaggccccgtaaaaggttacaagcttgaatgtaacatggccggtagcggaaatatcatcgccaaggatatacagctggacaacctatcttgcagcctcgccagcagcggggaaatcgaggtaataggaaccgtagatcgtgcctcattcaatgtagcgggaagtggtgagattaaagcctttgactgccaagcacgtaaagcagagtgtaatatcgccagcagcggcgagatcagcgtatatgccacgcaaatcttggatgccaatatcgtaggtagtggtgagattcattacaaaggagatccggagatcagtaagtctatcatgggttccggctcgatcaacaaagtcaaataaacatttaatacatacgaacgatgaaaacaaaattagtagcggtaatagccctcatcttttgtgccttcatggcagaggctagtaaagtagaaggtaatgggaatattattacgaaagagatatcggtagataactatagcgagatcgaactgggtggaaatatcgaatattccggcaataatttttggggaaatagaagcaacaagaaattcccggtattcaaatatacgcatggacgaagcgcttccttgaaaattacgatcgacgagaatctattcccactcctctcgatcaaatccaataacggacggttagctatccgcatacaagacgggacccgtatcaaaccgacccagtatgtaatcgaaggaagctcgaagactctgaaatacttaaagacttccggcccgatggattttgaggcgcagaacgctttttccgaggatcaactggaaatcaagatttccggctccagcgacgtaaagttcccacataacgtgaaattacgattaggtgagttctcggtatccggctccggcgatctggtttttgaagatttggactgcaagaatcttaccagcaaggtttcaggctccggagacatcaccttgaaaggtaaggcggacgaggcccgctattccgtatcgggcagtggagatataaaagcatacgacttatctgtcaatgatttgagttgctcggtaagcggtagcggagatgcccgtgtttatgccaaagataacatgaacctatcggtttcgggcagtggagacatccgctataaaggcccggcgaacgtgaataaatcaaagtccggctctggatccattcaaggcgcaaattgatcgaacacacacattttttttaatacacacattatcaaatttaaaaaagctactagatgtgatatccggtagctttttcttgctatttttgtaaccaactctttatttatagagtctaaattaaaaagtagaatcataaaaaacgatacttatgaaaacaaaggctatcttattaatggtatttttcctaggatgggtcactaccggttgggccgcagatcatgtaaaaggcgatggtaaattgacctcgaaaaagatttctgtcaccgattataacgagattaaggtggatggcgtaattgatttcaattacgagcaatccgatgatccttccaccgtggaggttaccgtagaccagaatcttcatccctatgtcaatatcgaggtgaaggatcgtgtcttaaccatcgctttcaaaggagcgaaggtagatcatttcacgaagtttatcgtaaagacgaattctaaatggcttgccgccgcaaaagtttccggaaatgccaacttcatggtaaacagtccgcttaccggagacgagaccgttattaaggcgaacgccaatagcttggtgcaactgaaagagacagttacggtcggtaaactggatttgaatgtatccggtagcgcaaatatggttgtcaatcatctggaagccgacaagatcgaatgtgatatcgatggctctggctctataacgatcaagaaaggtaatgcgaaagaaggagactacagtatcgtcagcagtggtgatatacacgcttttgggttagcggttcctcagctaagttgcaaagtaacaggcaatggcttagcggaagtacatgctaccgataatttaaaggccaacgtagtcggtaaaggaaatatccgttataaaggcccgacagcagttcaacagagaataatcggtaaaggtaccgtagaagaagtaaaagaatgaaaacaagaattatatacctatgtctgctggtgatcttttctacgacaggttgtatcagtaagaatgctcgaaaaggtatcaatgggaacaagaatattgttacccgcaccattcaagtagatgatttcgaggaaatacatctagggtccaatatcgaatcggcgaaaagcatcaatccgttcaacaagaagaaccgtgcgatatgtaattacacccaaacagatggcgcctcctcgttggagatcagcatggacgagaatttgtttgacttattggatatagagaataaggatcacaaattaatcatcaaggctaaatccggcaagaagatctgtccgacccatctggtattgaacacaagttccaagaacctgaaggaagcggggatcagtggcagcatcgactttatcgccgatcaaccgctacaactgacaaatacgtctttttatatcagtggcgtaggcgacgtgaaattagctgatttatcttgtgatactttcaaggtagctatatccggagtcggcaatatttacttgaatggaaacatcaagaaaggcaaatactccgtatcgggtgtagggcacgtatatgcgttcgattgccccgttgaggatctggaatgcgaagtttcaggtgtaggaggaatggaagtgaacgctacccagaaattagacgctagcacttctggtgtgggaagcgttaaatataaaggcaatccggagcatacgcagaaatccgcctccggtgtcggaaaaatcaaacaagcagattaatcatcccaaaaatcaattagatgaaaaagatatcacttttattccttatatgtggcttatttctagtaagcagctgtatccctacacaaaccataaaaggagacggcaatatcaccacggaaaacatcccggtttccgagtatgactgtcttgagttagagggaggaggcatggtcgtgaattacacgcaatccgacgctcctgaaggtttggaaataaagacagaccggaatatcttcgagaaatatgagtttaatgtagagaaccataagcttaagatccgtccgaaaaaagaattcaggaaacatacgaatttccgtccgaccgagttcatggttacggccaactcccgcaatctaaagaaactagcggcggcaggcagtacccatgtaaatataaattcccctctacaagccgaggagttcgaggcaggattagccggtagcgggattatccaattccacgacacggcctcttttacaaacctaaagatagagatcgccggtagcggagatttcgttggccataaagtgtattgtgaggaattaaacggggatatggccgggtctaacacgatcgttctagggggaaccgtaggcatagctgaattctcgatcgccggtagcggtacagtacgtgctttcgattgtaccatggatgagcttgagtgcaagattgccggtagtggagacatagaagcctttgtcgtaaacaaaatcaaggcagagatagccggtagcggttccgtaaaatacaaaggagatccccaagatatccaaaaaaaggtaatgggctccggtaagatcgagaaggtggagtgattcttacaaccacccctcctttttataccattcgatactttcttccaagcctttacgtaaaggataggccgggataaaacctaaatcatcttgaagaggcgtgacatcgcaaatccagttacgctgcttcaagatgatgtatttatcactatttagcgtcatacttttcttcaacaacttaccgatccattctgaacagtggcaagcgatacgcaccaatcccagcggtatacgggcatgcaatacccgcttctttcctaagatatcttgtatcatacgggcaaaagactcatccgtgtagacatctccgtcggctacaaaataatgccggttctctatctcctctttctcaagggaaaggaaggccacggtcgctaaatcttttacatagataaacgtgattcgctggggaatagcgcctacggcgaaatcgagtcccgactttacgctttgtatttccatgaaataatccttctcacccggcccgtatactcctgtaggccgcaagatcacgtaaggaaaataggtttgtttacggatgtagttctccgcctctagcttactttggccataagccgtgtccggccgctgcggatcgtccaagtgtatcgggcggaaagtcttctcgtcgcctcgcccatagctgcttaggctgctcatcaagaggaatttcttcggtttgcagccggcggcggctaaagcctcgataaatcgatgcgtattctcggcgttcacacggaaaaagtttcgcttatccaatgtcttcgtcaacccggcgttatggatcacataatcccatgccccatgctcacgggcaaagtctgagagttgagccgtaagcgcttcctgatcgccatatttcaagtcgatgaaatgaatccgcttatcttgcagatgcgctttactgctacccgcacggatacccgcccacgtctcatagccacggcgaagcgcctcctctaccaagaaaccgccgataaaaccactcgctccggttatcaatatcttcatatccttcatttttctttcatataaaatgtataataataccacaacaacccgatccaattcaagaacaggatcgtcagcatccaaagaatcttttgtttcttactgatgaaagggttttgcgatacggccttacatccgaacaggattacggcaatacctacgatataaccgatctccggcaagcttatccagcaaatgatttgtggtatcataaaaatagagttattcgtgaaaaagaattattcgtgttggtgtttcttcaagactcggtgcggcaagtcaccatgccccaccaactcgatcggacaagcgtatttctcgcccaaccattcctcagagacattcgctcccgggtgataatgcaaagtctcgtttacgcaagcgatatttttcaccatcgtcaaaaccgtaccgatatcatgggaaaccaagatgatagcgctctctttattgatatcttccaagagctgataaaaacgagactcgaatcgtttatccacatacgaattaggctcatccaagatcaatacctgcggacgggagacaatagaacgccccaataagacccgctgcaactggccgccggaaagctcaccgatggccctgcccgccaactcctccaatcccatctgtacgatcacctcgtctacacgctctctctgggatctattgaatggacggaacaaaggtttctccgcggataaaccggaagagatcacttcccgtaccgagatcggaaacttcttatcgatctggctcatttggggtagataaccgatcttcaaggaaggaacctctacattttcatcgtaaaaacgaatcgttccggaaataggaggcaatagacctagtatcacctttaaaagcgtcgttttcccgccgccattcggtccgataattcccaagaaatcatttttccacacatccagcgttacgttacgtaaggcgatcttattaccgtatccggcggtaacctctctcaactcaatcagcttgtccatcggctaacgattttgcgatatgaatcatttccttactccaatcgtaatccagcggattgatcgggatcagacggcaacctgtttctttagcgatcaactcggcgttcttctggtcaaactcccgctggataaacacgactttcgcattatgttcccgtgcggtctcgaccagttcctttaattgtgcgggagacggttcttttccgtccatctcgatgcaaagctgggtcaagccatattcgttagccaaataggtcagggccggatggtaaataataaatgtcttattgtcaagagaatgtaacaaaccggaaacggtcttttccgtctctccgatttctttcgtcagttgttcataattcgcttggtaatattccttattctccgggtccaaagacacaaaggcatccaaagtgttcttggcgatcaccttcgctccagagatagagctccacgtatgcggatcgacgcctccgggatgatgatggtggtggtgatcatgttcctcttcttcctcggggcttttaagtaaatcaattccttcggacaggtcaaaaaccttgagtcccggattattattccggatattatccatccaagcctgttcgaacccgatcgatccgatccttaaatagccttggcttttacccacctgcaccatttgctgcggtgtaggatcatacgtctccggactttgccctgccggaaccacacaattaatcttaaatttatctccggctatcttctccgcaaaataccgttgcggctcaatcgtcacggaaacgatcctctcatctgcccgcttatcgccgcaggccataagtatcaagacgaaaagagctgatatcaataccttaaattctttcataccacatatatattttcgcaaaggtaacgaatatcgggtaataaggcagcaaggagacgattcaaagttatcaggaagcagtctgacaaaatccccgtattacaaccgataagtaataatacggggattttatagggaaaaaataggctactctatttttactcggccagccatttattcatctgtgtaaggatccgctccttcatatcctccggcatattgccgatacgggcacgatggctgcctcggggctggatatagatttgctcgttcttcttgcctttgaaagcgggaaccatggccgcgctccacgggtcgatctcgccatagatgaagatcattttcggatcgttgtctttcaagaagttatagatcttgtggtacagagccggacggaagtctactttaccgaccagttcctcgggaagcatgatacggtttaggtatccatgggcgctatcgatcgtaaggtatttcttgaaaggttttacgtcatagccataataaccgagctcacgggcagcttgtacgaagaaagagatattcggctggttctcggcgaaataatcaggaccgctgatttccatcaaatgatcgaagagcgcctgatcgtcggcagacttggaagggatcgtacttaccgaagttccccactgccaaagagcgaatgaatattccagtacgcaataatccaatacctcgggcatcgggatacggaatgtcaggtttttattcttacaatagctctccaataaaggaagcatatcggacttacgcttcaagacttccaattgaaaatcctgtatcctctcgcgttccgctttcgtacctaccttacgtaagaaaggttcgtggcggccatcctctacacctttacataacggaccgacataaggaacggagaaatccacgtcgtccgggaaaaaggcacggtaaagcattgtagtctgcccccccttactgataccggtactgatccattttcccggatagatctgcttgaatgtattgcggacgttatgtaaatcgtacgcagagttctcggcggtcagataatcccagtttttaggttccggcgtcgactccaagaaataacggtactccacgaatactaagttcgcattcaatagtttagatagttcttcttgatatttcggattgagcgcataagccgctccatatccttcggtcacgataatggtaggacgatcataacctacatggcctacgataacccgttgcgtaaatgttccggcggcggggtctttcggatcgacctgctgagtaatacgtactacatatttctccggataataatcggattgaagtttttcaatgccactaattccttttagagcggcaagcttctcttgtaaatctccgggagcggccattaccgtcatcaccgacaggaagaaaagaagcaagaagttaaatgttcttctcatggtaatttagtcttttagatattgtattgttcgtaataatccctcatatttggcgcgtttcaccgccgaatgcgcaaagatacgattataatcctcacggctcaatgccttgaggtcgtcttttttaagggagagcaaagaaggggtgggatgaaaggctgctactgccgtaggcatagcgaagcggttccaaggacaaacggcttggcaggtgtcgcatccatagatacggttacctaaaaggacggcttgctcaacagggatttctccacgatgctcgatcgtaagataagagatacatttacgggcattcaaacgtttcggcccttccaaggctccggtaggacaagcgtccaaacagcggatgcaggaaccgcagtgattctttttgggggaatcataggtatcgactaccaaagttgtcacgatctccccaaggaaaaagaaagagcctttgcccgggatgattagattcgtattctttccgatccatcccaaaccggctttccaagcccaataacgctctaacagaggggcggagtccgtgaatacacgggcctcattgttggagggatgatgctcggttatcgctttccataattggcgaagtttatcctttacgaccccgtgataatcttctccgtacgcataatacgagatataaggttccgccggattccggagaactttcggataataattcaaggctactgagataactgatttggcaccttccaccaagccatccggattgagacggatttcccgatgattctccatgtatttcattccagcatggtagccttccgcgatccattggtcaaaataagcctcctcgctcccggccttcgctacttcagcgataccgcaagcggagaagcctaattccatagctttatcttttataaactgggagatacccattattcaaaaactttaaactcgtagccttcctttaagagccattcgacagcccggggcattgcctcacgcatattgcgctcggctttcaaggaatcgtggaagacgataacggaaccattacgggtatagttctttaccacgttgaagacaccgttcggagtcatatgagggctatagtcacgggtgaccacgtcccacatcacgatatgataatggcggcgaagccatactacctgcggaaaacgcatatgcccatgaggaggccgaaataaattgctgggaatatattcggccgccttctccacattcgccaaataattcttcgtccagaacttgatgccttggatatgattgaacgtatggttaccgacacggtgcccacgatctatcaccatctggaagacctcgggatgcttacgtacattatcccctaccataaaaaaggtagccttgatcccatacgtatccaatatatctaaaacccaaggggtaacctcgggaatcgggccgtcgtcgaaggtgagatacacacacttcttctctgccggtattcgccaagttacccccgggaacagtgccctgtaaaaccaaggcggttgttctataaacatactttgttagtcttttgccactgatccgtacgccatacggtaattatcaaattcctcttgataaggcttagcgaactccggattgtattgtttgctcacacgcaatacctcttggagaaccgccaagttatgacctaaatcactctcgacagatgataattgccccggacgcaaacggaaataccagtttatactgcgcaacgcattgtccgctatacctttataaaccatctccgccttctccttctggcccaactcgtaatacagctcacctaaagaaagagcgctataatccaacggaacattctcgggaggcaatacttccatcgccttatccaatacgttcagtgccttctcattcttaccttccgcaaccaaagcggcagccagcttgctgaacaatgcgatacgatagctcttgcacattcgcattacattctcatccaagtacacacccggcgtattgacaccaccccatttgaacttattcatcacgttgtcatacatcttctccgtattgatcgaacgaacagttccctgcgtctccatcggaacgatctgataagccataccggtctgctggaagtacggatccaatttcacgaactgatccgggcttacggtaatcgcgtaatagatcggacggttccagtcattcgtctgcaacatatccaagataatcaactcttgcttacccaagacatccttgcctttcaagtcaatcttcatctctttctgcaaatacggcaagttaacggtatcgatcacgccagcagccataaccgcggcggaatctacccccatcgtcaatgtctgcgcaggaatataatctaattcttgattgatacccgggatcttcttaaacttcggatcgttactacgaacgaaatcaagagcggtcttcagatcgatcgacttatccgtcatcgggaatacataagcggcatcacgagtaccttgcacataatcctccggttgccaagagattggaagcggatcggattcgtatgcttgcttcttcatttggttgatataccagtcggtttgcaaatagctcgtattacatacacgtacatccgtacggataccttccacctcctgtgcgtaccacaacgggaacgtgtcattatcaccattcgtaaatatgacagcgttcggctcgcaagattccaaatagttcgcaccgaaatcacggcaaacataacggttcgagcgatcatggtcgtcccagttctgcgcacccatctggataggaaccaacaagcagagtaccgtagcgacagaacccgctatcaccggagataacttgccatacttctgcaatcctttcgccaaggccgccacaccgaaaccgatccatatacagaacgcatagaatgatccggcatacgcatagtctcgctcacgaggttgatacggcgtctggttcaagtaaagcacgatcgcgatacccgtcataaagaacaagaagaacgtgatccagaatccctgaatgcccttctttccggcataagcttggaatagaagccccaagatacccaacagaagcggtaacatataatatacgttatgccccttattgttgataatatcgaacggcatatcctcttgcgggcccactaaagcctcatcaataaacggaataccggttatccagttaccattcgaaacctcaccgttaccttgtatatcgttctgccgtccggagaagttccacatgaaataacgccagtacatgaaattcagctgataagcgaagaaataacgcaaattctcggcaaatgtaggtttcatcaccgtcaccatctcaccgcaacggttgaacttcaccggtgtacctttcacttgtgcccactccttataagcagccacatgacgtccgtcgctactatacatacgggggaaaagcatactcaactcatccacgtattcgtattccgtatcgtaacgagagatataataatgatccttctcgtttttatctttcttaatgacacggctccaagtcggctcaccctctttcgatacaggtacacaagtgccgccttggttctcacgcttcacctcagaaacataggtctgaccgtagatcaacggagtcttaccgtattgctcgcgagccaaataagtacgcaaggtaaagatatcttgcggagcgttttggttcataggcgtatcggctgtcgcacggatcaatgtcaaggcataggatgaataacccactacaattaccatcaagcagaccaagatcgtattcagcatcttgatatttaccttcttgctcatgaacaaataagccgtcaaggcagccgtgaggatcacggcgatcacgtaaccactaccgataaacggaatacccaacaatacgatcgagagaataaaggatatcttcatccgcaccggatggatctcgtcttgcatcgtctcccagatcgcccagatcaaggaagccgccaatataattacgaacgcatatacacccgagttatacggcataccgaacgtattgacaaacaacagctcgaaataaccgcaaacctcaaccaagccttgtacgacaccatacatcatcaagcccacgatagcgaacgacaccaataaagcgatcagcgtccccttcatcgtaggattcgggaatttcttataataatataccagcacgatagccgggatacacaataagttcagcaaatggacaccgatactcagacccatcaaataagcgatcagcacgatccaacgatcggcatgcggacgatcggcggcttcttcccatttcaggatcaaccagaataccaaggcggtaaacaaggaagaataagcatatacctcgccctccacggcgctaaaccagaatgtatcgctaaacgtataagccaaagaacctaccaaaccgcaacccatgatcgtaatcatctgtcccagagacatcgtcttatcgtcttccacgataatcttacgagccaaatgagtaatactccagaaaaggaataagatcgtcaggccgctaaagagggcggacatcgtattgaccattaccgccaccttggaagggtccgaggcgaactgcgtaaataaattggctgttaacatgaagaaaggagctccgggcggatgccctacttccaatttgtatgccgaagagataaactcaccacaatcccagaaactggcggtgggttccattgtcatcagataaacggtagaagcgatcaaaaaaacgacccaccccaacacgttgttgattagtttgtactttcccatactttgtataagtgtgataattaattgtttctacttgcatacccacacgggcagtcggccgcaaaggtaatcatttacgtttaatacctaacgttccattcccctataaattatatagaatagattagaattatattaaacaaaccttatcactcaagtgttaatagaatagttgagtattaaaattatagggagatgaaagaaaattatgaactaattgataatgaagaacgccaccaatatgaatttcatatagagcgatacgttcccagaatagagtatataaaaaataaggatggggtaatttatctcacccacactgaggttcccatggagcttggaggtaaaggaattggtagccaattggtggagaaagtgctcttggatatcgagaagaaagacttacgtctcgttccgttatgtccgttcgtagctggatatatccagaagcatccggattggaaacgcatcgtaatgagtggtatacatgtttaatatttataacaaaattatatgggcaagaagatcgaatatacgaatggtgaactcaccattatctggcaaccggagttatgtcaacatgccggtatctgtgtaaagactcttcccggtgtctataagccgaaggagagaccctggatacagatagagaacgcgacaaccgcggaattaattgcccaaatcaagcaatgtccgtctggcgcgttgacataccgaatgaataaagaggtgaaatgaggcccccccgcctgtctcatcttgatagaaaggagtattccgtatcggatactccttttttcgccataaggacctctttctatgattttttgctagttttgtgatctagattcactatcaatgaaacaaatatgataaaaagacattctatcttaacggcaatcctgctttgtttcgtcgctttcacacaagtgatggcacaagagatgcaggaacccgaaccgcttccgatcgacccaaaggttcgatacgggaaattgagtaacagattgacctactacatccgtcacaacgatcagcccaaagaccgggcagacttttacatcgcccaaaacgtaggctccatcttagaggaagagaatcaacgaggtttggctcacttcttggaacatatggctttcgacggcagtaggaacttcccgaataacgggatggacgaatatatcgagagtgtaggtatgcgcagcggggaaaacttcaacgcctatacctcctttgatgagaccgtctacatgattaccaacgcccctgtcaacaaaagcggcgtggttgattcttgcttattgatccttcacgattggtccgggttcctagccttgaccgactcggctatccagaaagaacgtggggtcatccgtgaggaatggcgtacccgacaggatgcccagactcgtctatgggagcagcaactacccaagatgtacccgggaagccgttacgcaaaccggatgccgatcggttcgatcgacgtgatcgagaacttcaagccggacgagttgcgggcttactacaaaaaatggtatcgtccggacttgcaagcgattatcgtcgtgggagacgtaaatgtagatcaagtggaggcaacgatcaaaaagatgttcgccgatgtccctgccccggtcaacccggcaaaacgggaacaagtatcggttcccgacaatgatctacctctgatctcgatcgccaaagacaaggaggcatccaatacgatcctttatatcttctataaacacgataaattacccaacgacttgaatcgtacgattgccggattggtaaaggactatatccagcaaatatgcgcgtcgatcatggacgagcgtttcgatgatatcttacatcaagcgaatcctccgtttatctatgcccaagcctacgacgatgataatttcatgatcgcgaagagcaagggagcatggaccgtagccgctcttgccaaggaaggcgagatcgattccacactgaccacgcttgtcaaagagacccaacgggtaaaacaatatggctttacgccatccgagtatgaacgggcacgcatcaacgtgttgaaacaatacgagtccgcttacaacgagcggaataaccaaaaaaacgacgcttatgttcgtgaatatgtgaatcatttcaccaacggcggttatatcccgggcattgagatggaatacacgctattgaaccagatcgcccagaatatcccggtagagcaagtcaaccaatatatccaagatatgatcggagaggataatatcgtgatcgggttaaccggaccggataaagaaggtataaaatatccgaccgaggagaacctgctccgtacattcctcaaagcacgacagatgccggtagagccttataaggaaactgtctccaacgagcctttagtcccgaccttgccgaccccgggccagatcacggagacaaagaccggccagcacttcggagcgacagtatttaccttaagcaatggtatcaaggtggtattgaagcctaccgaattcaagaaggacgagatcatcatgaccgctaccagcccgggaggaagcactttattcggcacgaaggatattgataacttaaaagttttcaatgacgtgatcgagatcggtggattgggtaatttctccgccacggatctaagtaagcgtctggccggaaagaaggtatcttgcgccctatcgctcagtcaagatagtgagaacgtgaacggaatggccgctccttccgatttgcgaaccttattcgagttaatttaccttagcttcacggctccccgcatggacgaggaggcctacgcatctttcgagacacggacaaaagcgcaattgcagaatatggagttaaatcccatggtcgctttcagcgactctttgtctaaagcggtttacggagataatcctcgtgcgtcacgtcttcgtccacaagatttcgaacatatcagttatcctcgtatcatggagatgcgcaaggaacgcttctcggatgcttccggtttcgtattcacgtttgtaggtaatatccagatcgatagtatccgtccgtatatagagcagtatttagcgacattgccatctcaaggaaaaattgagaagggaaatccggcggaggttccatcgatgcgtaagggagactatatgaatcgattcaaccgctccatggaaatcccgaaagtaacggtagccaacctctataccggacaaatggagtacaatctggagaatatcatcaccgctaccgcattgaaacaagttatggacttggtatattacgagaaggtacgcgagaaagaaggaggaacgtatggcgtcggtgtatccgctagaatctcacctttcccggaaggaagaacgacattacagatattcttcgatacggacccggctaagtgggagcagatgaacacaattgtccgcaatgagttgaaacggctttccgaggtaggccctcgtcaagaagatttcaagaaaacacaggataacctgctgaaacgtcatgcggaagtcttgcaggagaacagctattggttgaacgtattggatgattattattataaaggatttgataccgatacggattatgagtcgattgttaaggcgctgactcccgagaagataaaggcattcgcccaaaagcttttgggacagggtaaccgggtagaagttatcatgcaaccctagttactattttgaggggatgagacggggcgtgccccgtctctactttgatttctttagtttaaaatgatcgaatccttccccataaaccccgattacggcgctttgggatacaaaggcggtcggatcaatatcattaatgatacggaaaatcgtagtggattgccgttttttagcgagcacgaacatcatcttctgttcttgccccgtatataacccggtagcatcgatcaccgtaacccctcggtgcaacgcattaatctccttaccaatctcttgatacttcttcgagatgataaagaattgcacggactggcgggcactgttcacgatctgatccagcacgaaactacaaacatataacgttacgaaaccatataccactttctcccaatcctttagcacgaaataactggaggtgataataatcatatcgcagatcatcatgacccgtcccagcgttatatcccggtatttattgatgatagcggcaataatatccgttccacccgtactaccgttcgaggagaaagcgataccgataccacttccgcagaaggaggctcccagcacacatgccataaacggttgatcttgtaataaatgcatcccggctgtcagctcctggataagggacaagaaaaaagtaagcgtaaacacggcgaagatcgtcttgatactgaacttaaaacctaatattttcaaggcaagcatcagcaagacggcattaatgaggaagtaagtgtactgaacgggaaatcccgtagcccagaaaacaatggaagcgatacccggcactccacctgtcgtaatgtcattcggcaaaaggaaaacggtccatccgataccgtaaaggatcatcccaagagcgatcattaaatagtcccgtgtctcccgaagcaggacttgtctggataaggaagaaattgataaagtagatttcatctcatttgtttatttttagcgggcgcaaaggtaatgaaagttattgataggaaatgcttcaccttatatttagccggaaatataatggttcactttcccctatttacagagacgtaagcaaaagccaaggaatgttaactatttatcagtaataaccccttttatataacatcacctttatttagaaaagctctataaacgagaacatgaaggagaaagcaggcatttatacgccttttccacacaaaaagacccgtttttcgataagaataccctcgttagattacacatatagtcccgttcacccacgcctgtacaggcgtaaacccacacatatagtcacgataggctacacatatggtcataatgggcgatatgactaccttataatgggcattgttgccccctaacgactgggccataaggcataagatatgagataggatgaatttatttcgctagaataaaaggccgtttttcaacaagtcactagcggatagacgattgctgtttttttctttcgtttttaggagcgagacgtactttggcccgaaataatcgattctcaaggacttcagtttacaaattgtcacattgatattctaaccagaacacgcataagccctttcatccaattgtagagacggggcgtgccccgtctctacaaccaagtatgtatgagctgcaaatatagacttacaatctcacattctccatttcctcacacttctcttcccgcaagcgttgaatatccttaagctggcggtcgaaaaacatgagcaagtcattgatgagccgtccgttctgggataaaagcaaaaccccatccatcaattgcgttgacaggtagcgaactttcatattacttacatgttgatcgggacgctgcagataaacggccatacatctgtacaaaattggtgctatttgtatccacggcagttttaggcctaccaacagatttttcacgctttgtaactgatggttcagataatcgaaatcatccgcatctctctcaaaacagaaagcttctttcaagcgtcgtgcctcttccttaaaaaatacatcactcaacatttccatgttcgaaaccggagcgtcttgctctgaaccgacaggttcagttacgggataaatgttttccacttccataatatattagcattaagcaggcggaaaaaagaacggtcccgcctgacccgttgctaaacactttaccagaaagctggaggcacattaatgcactccacgggggtacggaaccgtcatatcggatcggttacaggcaaaaaaatgcctgcaaccgaatagaagcaggtattctactctgctttctggttttaaaatgtttagcattgcaaatatacttctttttccggatatccaacctatagaggataaataatgtctagtaagtaaaaaatccggagctgatacctataccctagaagagaaaagtttctctcgtctatttaaattcttgatggggctaggcaagcatgaaaaataagatctgtactatacgggaattcaacgctaaatctacgattaaagaacagatagaaagtctttaggggtcaatactgttatagttgaatttacaaaccctttcacatcccgcgtaataatataatccgcccccgacatttttgcggagtagtattgaacggcatcctccaaatccgagctattggaatacaaagcattcataaatattccatcgtctatcgttgatatctcaacataaccgcatatacgcttcaagacctcaagaagttcatcccaagaataaccgtatttatgagccgtataattcgcattgattaaggtgagagcactcatgacaatctttagtttatcctctatacaatatctaaagatagtatcagcatcctctttgaagccttcccgctgacatatcatgtctagcaacacattggtatctacaaacactctcatccgatttgttccctttaaatgaattttgcggatgctattgctccttttcccatatcatcagcaggcacttctttatgtggccccttcaaatggaagctgtctataattaagtcagtcgaaaacacatcgttttccccatcttttgcccgtataagctcccgggtcaacattgtttctaaccacttactcaaagcctttccttccaatctcatcttgttactatatctatgtaacaaagagtcatctatatttaaagtgattgttgccatatatattttttcaagttattgtagcaaagataattattttcccattctatccgcacatttctccttaaaaacacgattatttcgatacacggggaaatcaccaattatgcataagaaggattaagtatgcgttgagactataaatagagccccctcacgctatactatcatggaaattgcggaggaggccgtttcagtctaaagaatcttataacttgacagaaatttgttcacctttgtactcaattacctttgcaggcttacccttattatcccatcccgcaggagcattcgggcttacgtaaataatattgaaagttctctctgataacatcccgggataagagccttcacgactaccgattgtcaaagtattcgtcgcatcgctataattaaaatcgatcttcgaataagttcctttctggtaattattgttcgtaccttcatcttcatatagatagaaggagccatcctttccggcataaatatagacatctatcacttccggttttttctcatttacataagtgatctccggaccatataataagataccacctgacggagcaaatatcggcatacgttcgaatggagcctcaacctcctgcttttggccacctttataacgtttacccgtatatagatcataccaatccgttcctttcgggaaatacacctcacgggaagtcgctttataggtatataccggggcgatcatcatagaggggccgaacatatattgggtagaattatcccggacagccaagtcggaggcataatccatcaccaatggacgcataatcgtataatcatcaaaatacgtcttacctgccaacgaataaatataaggcatcaagcggtaacgcaattgattataatacaagatcgtctgataggccggatgatcttctggggcgatattataaatctcacgcaatggaaactgtccatgcgcacggtacaaaggggtaaatgtgccaaactgataccaacgggcattcagttcccgccattccttcaagtcgtcattctcaacaccggtcttgtcataaataagctgtcctgtacgataacggttctccacgcagaagccaccgatatccattgtccaataaggtataccggagattgagaagttcaaccccgcagaaatctgagctttcaattcctcccaacgagtaccgatatctccgctccaagaagcggtggaatacctttgtaggccagcgaatccggaacgagtcaacaaaaatacgcgatcatccggattttccttcaattgcccctcataaatagcctgcgcattcaccaacgcatacgtattataatattgagctgaagggcctaaagctgtcgggccggtcaacgccttttggtaagacatcggtgtacaatccttaatattcggttcggaagcgtccatccaccaagcgtccactcccaaacgatataggttatcattcatttgtttccagaataacttacgggcaccgggggcataagcatcataaaatgtagccacgaatccaggtggaacaaaatcaaggatgctatccttaaccgcttgcaggtaaacccatccgttagctgccaattctttataattctttgtggtaggataaaatttcggccaaacagagatcatgaaacgggcattcaaatcatgaatcgcatcaaccatacctttcggatcagagaaacgtgccggatcaaactcatggcttccccatgaatcagttttccagtactgccagtccatgacaatattatccacacccattttacgttttcggagctcacgcaaggccgtcaatatctcatcttgcgttttataccgttcacggctttgccaaaagcccatcgcccaagcaggcatgatcggcgatttaccggtgacataccgataacctgagattacctcgtccatcgaatcaccatgaataaaataataatctatatcatttcccatctccgaccacatagacaatcgccctacttcttcttccggacgaggagacaatactttcaacccaatataagagccggctccctcacgccattcgatacgcaccgggactttctttcccgcttgcaaatcggccgtgaatttcacgctattaggattccaagagggccgccaacgttcttctaccaccagtttattatccaagaagactttcgtatacgctccatagaataacttaaaatgataaacaccactttctttcggttcgatctcaccttcccaaacgaccaagctgttcctgaaacggaatccttccgggaatttatcaaacgtctctcccttaaaatcaaacgtcttcggaagaggttggtgcgtaaacagggtctcgtaatcaattctggactcttgacgttccgcaaagacctccaatccattatttttataataagtagcggtcaaacctccctctttcccattcttatcgtacaacttaaagatatccaagttcgaataagggcgtggatcaccgtaccgggaataagaatagttatcgaataagacaccataattcttggaagaaaccacgaaaggcaccgatatcttggtattatactgatacaactcctcatttttcgatttataattaaattcatccgactggtgctgccccaatccatagaaagcctcgtcttccggtgaattaaattgctggcgagtcgtatagcctttgcgaccttctacctctatcggcgtaaactgccgtccaccgttactttctcgcaatattagcttacccgacatatcatagaatgtcacttctcccgtaacaagactgacggccgcacgtaatttgccggtattcagaaatacggaatccgaagtcgattcgacattccattttaccggggcctttaccggagcgacacggactaagctctgcttatcctgaatcttagcctccgggcttgccgtcacttgaagaacctcatcattcacaaccaacaaacgaaccgttttcgattggttcagctcgccttccggcaagctgaccaatataccattcgctatctttttatatccggcctgcgccgagaatggtaagacagccaatagcccatataacaataaatacttacatctcatatcctctaaatttaaagaattaataacccggattttgtgttaatttcgtatttaactcaagcacagaagtagggatcgggaaaacggttgtaaaaccggtattatccactacgtaatcgccagtggcgacattatgatgcactcccgcataacgatcagtcgtaggttccgtataagtcccgaaacgtatttgatcctgacggcgcatcccctcataagagaattccaacatgcgttcatccaagatatcttgcaaagtcacgttacttttctgtccggcttgtacacggtcacgaatctcattcacttccgcatcaccgctttgtcccatacggactttcgcctcagccgccaataacaaggcatctgcatacctccagaacaccttatcattattatgattcaaataagaagaagtcgtattatccacctcatatttagacatacgggctcccgcaaattttaatatctggttcggtacatcctccttaaaatcaacaaccacatccattgggttatagcataactgagctccatcgcctaaacccgcatctatcggcttgccatccacgaacaccggtccataaaagaacgtcatatccatacggggatcttgttcatccgtaccgtacttgaaaactttcatctgttctacggtagcgcaggcaccattccaaccttgcaagccataagcggatgcgtgggccgcatataatgtacgagtcggattataatcgctcactttataggtagtaccatcactcggttgagtccagatattttctaccgaactatcgtttgtcttggaaaaattctgggagaagttgggttgtagactatatccctccttctctatctgtttctgacaataaagaaccgtctcccaagcgtcacgagtcgtaccatccaacgcgatcttaatatttttgcccgcttggtttacatacggcgcaactttagcgataccacccaccaaagaaccatcattccaatcatcttttgacaagataggactattaatagcgactttcgccatcgccatataccccacagccttggtcacccggccataatacttgcccatattctggcattttccactgggcaaatggggaatgcaatccgtcaactcatccacaataaactgatagacctcgcttctcgaagattgattcacatccgccatcacagtcttcgaagaagtaaccagaggtacacgaccgaataaatcgaccaaatgataatacagaatcgcacgcacggcacgagcctcatattgataatcttgcagatagctctccccacccgcttgaatgaaggtctccagattatcgatcgaggtattacagttaccgataatcgtatatagcgcattccaagtactctttatcgtagcgttacccggaccataattatgcaaaaacaaggattgccatttacctccatctacccagtcgccttgtcttcccggcaatatccaagcatcggaagaaaactcttgtaaagtatgcacattatccgtacttccatataaccgattcccaaatgaggtataaatcgtagcgatcgtatttacatacaccaatttctcacttttataagcttcttcttccggtatcttactcttgggatcctcatccaaaaatccggaacaagcggagaataaaccacctaaaatcagcatggagctcaccaatacttttttcatgacaatacgtattaaaagattaacaattagaatttaacacccagtgagagtgaataagtacggctcaacggataaatcaatttatcatccacacccaacgtacccgaaacagaagatttagacgccacattcgccgagttgataagcggcgtcataccagaataacctgtgatggtcgcgacattgttaacagagaacgccaaacgcaaggattttaaatacttctcaatcttcagtttcttgacgggaatattataacctaacgtaatatactcgatattaacatagttaccattttccagataataatcagaaatcttgatgtcgtatatccgcttatccaacgccccatccaatatattataggttggatacaatgataaattattaaacgtcaaacttgtaccattatagattttatgcccgaacgccccatttaattgaaccgccagatcaaaatctttatatcgcatattaacaaagccacccatatatacctttggtaacgcttgacccgctatataacggtcaccgctatccgataagtccactttgccatcgccatccagatccgcgatatcataaacaaacttaccatcttccttctctaccaatccgttgcaatgaggaatatagaatacgcctaagggttgtccctccgtcaagtaagtaacacccgcatactgggttaagctaggagcgttcaccgccgatacttggatatatttactagtcgtaaactctgaccccatatatgtaccacttaatgatttaagcttattcttctggaaagacagattcgtacccacggttaatgagaaatcttttttcttgatgatatcgccgctgatcgctacctcaaagccgttattggtcatttctcctaagttcgcaagcatagacgtatatacgaacggaggaaccggaacggtataagtgtacaacatatctttcgtagtagacgcataataatccattgtcaagcgaagacgggattggaacatcgctaaatccacgcccacatcaaacgtatacttcttttcccaacgcaaatccggatttggatttgaatcgatatagaaagtagtcgtagccgatccatccaccaaggtcgttccattcggagccatcaaggagagggattgatacggatcgatcgcatcttgattaccggtcacgccatatccggctctcactttcaagttatcgataaaagtcaaggacttcataaaagcctcgttcgaggcgatccaagcgacagaagccgacgggaagaatccccatttattaccataacctaatttagaagaaccgtcgcgacggacattcgccgtaactacgtaacggctatcatacatataattaaagcgtgccatataagataataaagcgaaacgggtagcattagaggtagcgtcaccccaacttatgttagcaccggctttcaagttattataggtaaaataattcgtctcgtaaccgctggttttcgtggaagactcgaacaaagactgtgtctgcgcctccaataaagccaaagcgttaatgctatgccgtccgaattcccttgcgtaattcaattggagatttcccatcaagtcatttcgttccgcatatttcaaataggcctgtccattcccgttcatcgaaccctgttggatatcattcgggatataacgccggtcattcaagctatagtaagtatacgaaccgaatcccgtcaagttcaatcccttgatgatctccacgtttacacgtccgttcacgttcacatgagaggctattttcttatttgtgatctccaacatacctaaggggttatatacctcgatcgcggtcttatcctcatcccagatacccgtttccggattcttatagttcggatacgtaggattgtaagctgccgccgaataaatcgtacggtacatatcaaattgatgatcgccttccctacgtgatccaaacatgcctaaatcaaacttcacccgtttctggaaagcatactggcttgcgtccactttggccgtataactattggaagaagaattcttcaacaaacccggacggcggatcacaccgagagaggcccttagattggaattatcattaccgctcgtaaatgagagattatgggtctgggtaagactggcagaacgttccacctcctcaaaccaattcgtactcgctcccatatcattcgtactcaatcccatagccaccgcaccggcacgccattcatcggccgttaacattcccaagttcttataaaccttattaacaccgaataaaccattatattcaatttgagcgaaaccggctctacccttggcagtcgtaacgacaattaccccggacgcaccccgtgaaccatactgagccgtctccgaagcatctttcaagatagtcaaagactctatatcggaaggagagatggcgttcaacatacttaaatctccaaataccccatcgatgataaccaacggatcattgcctccggatagagaggtagtaccccggatacggatattcatatcactcgtagggtctccacctacattactgataacaacaccagcgaccttaccctttaccgcatccaaaggctccgtaacgacacccgagttcatatcctctttctttactttctccacagcaccagatacggaacgcttgtttcctatggcgtaacccacaacaacaacatcatccagcctttgaacgtcttcatccaatgcaacattaaccaccgaaagattccctatactcaccttcttacttacatagccaatataagagaagactaatgccgcttttccattttgtacttccagcacataattcccgttaaagtcggttatcgtcccgttttgggtaccttcctccagcacgctgacaccgatcatcggttctccttgggcatcttttacaaccccgctaattttcttattttgttgctttattaccgcatggatctctttgttcgccttcgctttgtagattataatatgctcatcttttatctcatacgtcaatccctgttttctcagaaccttattcaagacattctcgagtggctctttgctgacatcaacagacaaaacctctttcaaattgacttcactacttttatagataatagaataaccagattgtttttccaactcacggaacacttgttctaaagtagtctgattcagagataaatcaagaacaaccggagactctgtggcagctaatatattactcgtatttagtattaaaaataacatgccgattgccataacacgaactataaagtatggaacaccatactttacacgaattcctgtgtctttcttcatgatagataaatttaaatattaacaataactagaggtcatttcaaatagcttggctcctacactcttttccagatttcacttcataggcaaatgaatttaagtattaaacgttcttgactagcttgatttttccatccttctgaatatatgtccatgagcgttggtaagataactttttaagaatatcatccaaactcacgtgtttccggaaacttgcgacatatttatcatactttatcgactcggagtctatctcgatcctcacgttgaaccgcctttccaatatggtagagatttctgccaacgtctgatccttaaacaccagaataccgtccttccagcacgtataatcttccgcatccacctcatggcaatagagtttacctgtatggctatctttaattacctgctgattaggagataatatcatattctccttgccatgatccgtcaatacttgcacggaacctctttccaaggtcaacacggcttggcgatcagtatcataagccttgaaactaaaacgggtacccaatactttcgccgagaattgcttcgtatgtacgatgaacgggctctccatcttcttcctgacatcaaagaatccttcaccctgtaagcacacttcacggttatcggaaaattcggccggatatgtcaagctagatcctccattcaacgtaacttgagtaccatcagaaagggtgagatgcgtgatagcaccctccggaacttccacgacaataggcgcttgagccgttaagagctgccgactattgatgattccgatagaaacgattacagaagaaagaatcaagattgcgatagaagcggccaccggccaataacggaatagacgggttcttctagttgccatcagattataacgacgtcccaacttctcttccacccgtttgaaaacagcctcttttccctcctccgcttcttgaacggataaagtgtgtttcgcttttatcgcatttaaaagctgtaaaatcagctttatctctttttcttgattcttttgattatccacaatcatacactttttacttgtaggagccacctacatttgattaatgattctataaataaagagtatggaagtcttttttacctataaagggtatcacgagtttaacattcattaaaacaacagatgaattctccttttaacgacattgtaatatcggctcaccgcatccaacattttccggattgcgatattcatttgttgctccacggttccttccgttattgacaaggcttgagcgatctctttatgcttcattcgctcttcacgagccaataagaagattaatttgcagcgttcggggagttcggaaagggctttattatatacctctgtcatctcggcgtcaagcagatcactatctacctcattcgtatctatatacaaatctatcggtagctcatcaatggatatgttttggcgttgatgctctttctgtttcaagtaatggaaagattcgtttctactgatgataaataaccaagcgttcaggtcttctatatcaatcaattcttcccttcttttccataggatacagaatacctcggatacgacttcctcacgatcttccttatttggcagaaaatatcccacaaaacgattgaccgtggcatattgtatgtcaaacaactcacgaaaagaggcataatctcctttcgcgacacgagacagtagagtttttaatatgaattcgtttttcattacgattagtcaaatccattgtctttcataacagatggactcatctctctccttttgtggcaaaagtaataaaaaacttataaacaaaaagccttatcaaatatttagcttcttcttaataagagggaagcacttatatatgataaggcctataaaagatacaagacttactaactataagctatgctggaacatccaagccagataatccggttcggcgaaagcgttatcccaactgttatggtctacaccgggaaattccttataacggacatcagctcctgctttcttcaatgcctcattagcgtcacgggagaattgtacatcgactacgctatcggagccgccatgataaatactgaaagccgtcttgcccttaaagtttgccaaacgttgcaaattcgctccaccacagatcggggtggcagcggcaaacaggttcgggtaacgcatcacgatatcgaacgtgcccatacctcccatcgataggccggttacgtaaatgcgtttcgtatcgaccttaccttccgctatataactatccaataattccttgactgcggccattgattgcgtggccggggcattcaacggataaaaacgcttcccttcttttccggcgttcaatcccttatattcagaccaagtcttctctgccgggcattgaggcgctatgatgatagccggatatttggtttgattctcgaaagaagcgaacatatcgccaccatgtactaattgggcctcattatccgaccctcgttcgcccgctccgtgcaggaacaggattactgggtatttctgcgccggattataatctcggggatacagaacccgataattcaattgataaccatcacgagccgtaaactgctttttcaaaaaactagccttatcaccagcatatccagcaatggagagaagaaggcaaagagacaaaaaaaagatacttctaagtgttttcatacaacattatatttaagttattaataaatcacacattattatttagttgtagagacggggcgtgccccgtctcatcccagtaaaacagtaactttaagataccatcagacggtggaagacggggcacgccccgtctctacaactaaggagattatatatagaaacaatcacttgcccagtttaggggattgttttcaatgtaatctgctatacgattcatttcagcatgatcacgaataatgtgatcatggaaacgtggttgccatgcaaaaatacgattattttgatgtgcatataccgtgacagcagatttaatgcctccaatccctatcgacagcaatcctttattccccaatggtactaacgcctcatctcccgccacaaagaccacggcatgtacatgattaggcatcacaacaaatagagggatttcaaggtatggataatggttatttgcatgctctaaattatcatgagtgaagtgacctaatggattcagcgacatttgcccgccaagtacacaaccaaaataacattgtttatgtgctgtacagatcgtgataaaataaatacctccattgtaatcgtgccaagtggcacgggcagattcgatacggaaacgattttgatataggtttgccatagttatgtgtcttagttaattgttctttataggtacaaatatagcatatattctgaagcgaaagaatataataaaaaatatctagttgtagagacggggtgtgccccgtctctttccaacaaaatggtattctaaattactatcagcctgtgtaagacggggcacgccccgtctctacaactggatgattggttttgtcgcttctgatacaccgttctcgttgaatgcctcgatggtgaaataataaggctggtcggtggacagactctttaatagtaattcattctttccgtataggagccatgaattgtatagtttatcgggagcgataccccaacggatgttgtagccttggctgttcttggctgcgtcccaagtaatcatcgcgtcacggcggtccgcttggcgaacgaccttgaagttcttcaccgtcgcaggcttcttgccctcaccgataccgaacacacgcaagtccgagatcgccagatgaggcgtcgggacctctatattcttataacggacataacggacacgagccggattatccacttgtacgtaatcattcgggacatccttataattattccggcgatccaccaacgttacccaatcctgcccgtccaaagagccttccaccgcataacggtggcgtaaaccgggaatacgtccatacatattcgattgatgatcgtgataattcacttgcacggcatataccatagcgggagcctccagatcgatctctacccattcggtatctccattcgtgcgagccatccagaatgtcttacattcctcatccgtcaagttggccggaaggaaattggcggaggtcttgggacggttcgattccgtgaatccttgcgcggcgggagcggaaccctccgcatacgaggaagctttcaccggctttttataagaaagcaacatccaccccgtaaactctcctttctttcccggctcggcgggagcgtaatgcggataatcaccgaagttattatcacaatacataatgccctccttatcgaagaaagtaggatacatgcagaggcgacgctcccaattcaccgtagccgagagagacatagaggcgaaatgccaataattacctcccggccccaccaaggtacttccgtgtccggcaccattcatgaaaccaccgggcttatagcttaccgggttatgcgattgatacttatacggacctaatggggagtccgccacataaacaccatcggcatatacgttgaattccgtaccgggggcggcatactgcatataatatttaccgtcgtgcttggtcagccaagccccttccatatagcctcccaataccgtatcggtatggttctcgccaaaacgttcccagccatgcttcggcatatccaagccgaaaagctcgaccgtctcaccctcgatcaagaaacggtcatccttattcagtttcttgccccgaagcggataaacattggaagagccccagaataaataagcttgcccgtcatcatcgatgaataaatccgggtcttgtaggtcgtggagtatagcaggagtagcgttccaattaccggatttcggatcatcggtataaagaacgctcatggagccggacggatcacccatcacataaagcacggaatccttataattatgagcggcgggagcgttggaaccctgaggataccagtttttaccgggagtgataaaatcccagttcaataagtctgtcgaatgccagtagccatgcgagcgggttacgaacatataatactcgccccggaactccaccacggcgggatcggcccccgaacggtacgacaggttgttcgacgagttataaatcatatacgtataatccacattaagcggattacaatacgtattcgcccgcatggattgagcggtggcggaacctccggaagcagccaagaacagagccgaaaagatatattttgataatagtttcatgttgatatgtattaatttttaccgcagagagaaagaagactgattcgcctcgtcggcagaattcaagcctacccaaaccgtgaaatcacccggctcggctttcttctgcatatcgataccatagaaagccagcaaagcttcgtcaatcgtgaaagagacttgcttcttctcgcccgctttcaaagtcaccttctcgaaacctttcagctctttaaccggacgggtcacgctacccgccaagtcgcggatatacatctggatgaccgtctcgccatccaccttacccgtattctctacctcagccgttaccgtgatcttaccccctttcgtgaaagagttctgatccagcttcatagagttcacggcgaaagtcgtatagctcaagccataaccgaacggatacaacggtgtgttaggcacatccatatatctggatttataatccgtatccggagcttccggaggaaccgggcggcctgtcggtttctgattgtaatacagaggcaattgacctaccgtacgagggaaagacatcgtcaagcgagcggacggattataatcgccactgatcacatcagccataccatgacccgccatcgttcccagataccaagcctccaagataccgtcgacatgctgatcctcccaagaaagatccaaaggacgtccgttcaccaagatcaaacctagaggtttacccgtctttttcaattctttcaacaaggcttgttgagcgcccggcaatttcaagtccgtacggcaagcggcctcaccactccagttgaaatcctcgcccatagccgccaatacgatatccgcacggcgagccgtagcgatcgcctcagcgaatttagatgaatcatcagtcaagagatcacatccctcggcataaatgaacttcacgttcgtaccggcatatttctcggtcaggccctcgaacaaagagatactctcctcacgctcaccccggccggcccactcgccattctggttgatcttatcttttaccatcgggccgatcaaggctaccgtaatatgcttatccttcgagatcggaaagaagttattatcattcttcaaaaggacgatcgagcgagcggaagtctcacgagcctcttgcaagaactccggcttcatgatcgtattcttctcacgctcattgtccaagtaacgatacggatcatcgaacaagcccaagaggaacttcatctccaagatgctcgccacggcacggtcgatattctcttccgagactttaccctctttcacggattgtacaagatattggctgtagatgccacccgtcatatccatatcgataccggcgttcgcagccagttccccagcctccttgtcatttcgcacgatactatgggctaccatctcattgataccggtataatcggtaaccacgaaaccattgaagccccagtcctcacgtaacaaatcggtcatcaaccatttattacccgtgctgggcactccgttgatctcattgaaggaggccatgaacgtagcgactcccgcttccttagccgctaaataaggcggcatataataattcatcaatgtattttgcgacaactcggacgtattataatcacgtccggcctcagcggccccataagcggcaaagtgcttgcaacaagccaagaccgtattcacgtcggccaacgaacgccaatcgtttcctccttggaaaccctcgacacgggccttcgcgatcaagcttcccaaatacgggtcctcaccggcaccttccattacacgtccccaacgggcatcccgggagatatccaccatcggggcgaacgtccaagcgataccggaagcgctcgcctcatccgccgcgatcgccgcgcttttacgcatccgctccaaatcccaagagcaggattccgccaacggcatcgggaaaatcgtacgatagccgtgcacgacatcataaccaaacaatacgggtatcttcaaacggctctcggacagagccatctcttgcattttacgtacgccatctaccgtatatacattaaacaagcttcctacaagaccttgtttcagcaaagtctcataatcccccgtcataaccgggccggttacatcccagttacaggagtattgggccatctgccccaccttttcctccaaggtcattaattggagcacagaatctacacggcgttcaatatttttgtcgccgctgaagcttttccagccacttacagcgggttgctggcatccacctaaggtagcggcaacggccgcaccagcgataaaagtcgttaaccttttcattattcgtatctgtattatttgttccaagttacctgcgccgatttcacgtcccgggagttcgtacctacgtaaatattgaataagcccggttcccagatgtattccaacgcgctgttataaaatttcaagtcttccggcgtaatcgtaaaagagacttttcggctctcacccggtttcaaggagatcttctggaagttcttcaactctttcatcggacgggagatgctggcagccggatcgccgatatataactgtacgacttcctcgccctctagcttgcccgtattcgtcacctgtacgctggcggtcaatacaccgttctctccttgcacactcgtcttatccagctgaagatcaccgtaagagaaagtcgtataactcaagccatagccaaacggatacaaaggatcgttcgtgatatccagatatttagaagtgaaatgatcatccggattcattgggcggcctgttttcttagcattgtaatacaaaggaatctggcctacgctacgagggaatgtagtcgtcaatttaccggaaggattcacgtcgccgaacaatacgtccaccaatccgcgagccgcggcggaacctccatgccaagcctcaacgatcgcggagaattggctatcctcccactccaaggtcaacggacggccgttcgccaagaccaatactaccggtttaccggtctccagcaaagctctcaacagctctttctggctctccggcaaactaatatccgcacggctgcaagcctctccggaccagttattcggctcacccactacggcaatgatacgatccgcatctttcactttctcaaccgcttccttcaccaaacgggtattctccaccggatcaaccttcaagccactggctttcgccaacatcggctcgttcgtcaaattacatcccttggcgaagatcacacgggccttattgccaaccatttctttcacagcctgcactacggaagccgacttcgccgtatcgataccacaccatgtcccgaacaactcaaccttcttatccgccaacgggcctaccacggcgatcgtccctgtctttcgcaaaggcaacaaacccttgtcattcttcaacaagacaatggatttgccggcgatatggcgagccgtattcatatgctcatccgtgaacgtattctttttcgcacgatccgcgtccaagtagcgataagggtcctcgaacaaacctaatttatatttcgcctccaatacacggcggcaagcctgatcgatatccgcttgagacacacggccctcttccaacgacttcttcaaggtcgtgatataaccatttgtcatcatatccatatccaagccggcatgcaaagccaaggccgatacggtctgcgtatcacccaaaccatgattagtcatctcgccgatcgaattataatcggaaacgacaaacccattgaatccccattgatcacgaagcaaatcggtcaataaccagcggttacccgtagccggaatcgcctccaccaaattaaaggaagacatgaccgtggcacaaccagcctctacagccgctttataaggcgggaaatactcattaaacatcttgatacggctcatatccaccgtattataatcacgaccggcctcggaagcgccatacaaggcaaagtgctttaagcaagacaagatcgtgttctctttcgtcaagtcatctccttgatagcctctcaccatggcggcggcgatctttccaccccaccaagggtcctctccactaccctcggcgatacgtccccaacgagcgtcacgggcgatatccaccatcggggaatacgtccatgtcacaccgtttgagctggcctcgatagcggcgatacgggcactttgctcgatcaacgtcgtatcccagctacaagacaaagccaacgggatcgggaagatcgtatgatatccatgaatcacatccagtccgaacaaaagcggaattcctaagcgagattccttaaccgctatctcctgcaatttacggaacgtctccagctccgagcctcccgtagcacccagccagccccgacgaatcgtctcgtccgcaccttccgagccactcaagatgccgggaacaccaccaccggacaagttcagctgtccgatcttctcatccaaagtcattttacccatcaactgatcgataaacgtatccatcgctctcgtatcttgaacgggcttttgtccgtatgccgcaagtgccaaacaagcggcgaatgataatataatctttctcatgttatttaaatattaagattctctcgcattatggatcgtgaaacccaatttcttcaaaccgtcctggatttccggacagctcataaacaaacgccacagaaggcccgtacggtaattctcgatcatcggtgcgatcgtacattggtctatcgccagataacgatgcggataccaattctcgccttcactgaaagcgtcgtaaaaaccatacttaccccagatgctatctcccagattgaaatagaaatgcttcaatgccttcgaggattcctccggtgtatacggataactgctcaaggtggctgtcggcgtaattaccccatgatcgttggagggcatatgcgcgttatagcctttcacggaatagctggcggtcaatccccagcaagcgtcgctatatcccttgaaacccttcggattctccgcgcaataacggtaatcgatcaagacgtgattccggttcaagtcccagtagttagcgtatcgatccgacaagcctaccggacataggccgatataagaataatgcgcccaaaacaacgggccgccgtactcctcggcataattatgtttcaagatcaaaggtaaatcgtaagcgaccgcatcgctcttgatcccccctttacgagcccatccgttatgataagcggaagccgggatcggatacgtaggcgaagacgccgccagaatataagtgatcaagcattcattataaccttccaaaggaaaattcatctcccatgcgtaatccgggctccaatgccaatacaatacatcctgcccgttcaaataccaggtccattccatctcacgccatagctggtcaatcttcgcagccaacgctttctcgctctcattaccatccttgaaatattggcgtacgcataagagaccttgcattaagaaagcgctctctaccaaatcgcctccgttatccttctggccgaaaggctttaccttacccgtaggtccatgcatccagtgaggccagaccccgtggaaacgatcggccttcgccaagtaatcagcgatttgatgaaaacgggccacaccttcctcacgggtgataaagccacgctcaatacctaccaacagcccggcgataccaaaaccactacctccggtggtcacgatatcagcgtcgttctcaggatacacgccatccgtatggatacgctcacaggccagtccggaggtaggctccgcaccttcccacatataattaaagtgagccttttgtatataggtcaagaattcatcatccgactgaaaatccaacttacgctcattgggcgtagactctgcggatgtgtcacttttcttggcctcatgacaagcggtcaacgaaaagccaagcaacagggtaacaacgcctgtacggaaataggtattcatagatatatacatttaaaatagttatcgtctcaatactttactcatcggtgaacggccgctctctcccaatgcctcgatcgagaaataatagtccgtatccttatccaagcccctgaaatcgtacatcgtatctcccagtaccgtgatactgttgtacaatttatccggcgttataccataatagatattgtaagcgtacgcctcttttaccggctcccaagtgatcagcgcattccgcttatccgcttttgagcgttccacctttaaattcttaacggcggcgggagcttctcccaaaccatttccaaaaatacgaaatccggacatagcgaagttgcccgaaggcacatgttcgttcactattttcaaataacgggttttcaaaggctcacgcaactcgatatagtcgtgcggaacgtccttgtcgttatcgctcttatcgactaccaattcccaattttgtccatctatagaatgataaatacgatattgatgatacaagtccatcgccttattatgctgtacggctctatgctcgtaatagttcaactggatcgcacgtacctctttcaatccctctaaagagatctggagccattcacccggctctcccgagcgggcggaccagaaagtacgcatgctctcatccgttacattctctggtactaacgtactatccatggaagaggccatcaccggttttccatacgatagcaacatccagccggaaaacgtattcgcgatatcatctaccttccctttcggcgtaagcaaaggatagtccccgaaagcggtgttcgaatacatcacgccatccttatcaaatgccgtagggtacaaaccaatacgacgctcaaacttatatttcaaagaaagcatgcaagtagccacatgccagtaattgccatacgcatcctcgaaagtaccaccatgaccggcaccttgtacgaaacctcccggcttatagctcatcgggttatgtttctggtaggtgaacgggcccatcggcttgtcggatacatagacaccatccgcatagaccttgaactccgttcccggcgcaccgtattggaaataatatttaccgttatgcttggtcacgaaagctccttccgtaaaaggcgctaaagtcgtactatcgtcattgttcatcccgaaacgttcccatccgtgttcttccgggcgcagcatcatgatctcttggatcttgctgatcgggtggaaatcacggcgatccaattccactcccttcaaagcaaactcattacttgaaccatagtacatatacaaacgtccgtcatcatccagcaaaaatgccgggtcccagctaggaagagccgttttctccacataccgcttgaactttccgcttttcgggttcgtactataccaaataggcaatcccgcataggtagaaccggtatagaacaaggtatcttcacttacgaaagcggccggagcgcacaagtcgtcatcttccggataacgttggaaaccggcgaatacaaactcccaattgcttaaatccttggaataatagaatccggcttggttcgtggcgaaaaggaaatattcccctttatacatgaccatcatcggatcggccgtagagcggaaagagccattcttcaccaaatccggcagattcgcccggaagcagtagctcaaattcatcgggttgcaataggtagagggatgatcggccgtagcgtcgaaccagcgggtggcttgctgaggagcttttacccgtacatcacgaggatccgcttccatccggatatctattttcgtatcgttatcgccaaacgtgcgataagcgtacttcatccccggataatacacgaataactcatgatcgtagcggcttgcttgtatcttataatagcctgtcgcatcggtggtataatgaaccgggctagccgtgaacatcaccgtagcgccttccaagggcttgccgtccggtccggtaatcgtaccttccagaaaatgtttttgggatacggtaatatagtaatcgcttacctgccccttgatcacgatcacggaatctccccgctcgtttacttgagcgtttacggtagagaccgcgaagaaagaggcaaggagtgatacgagcatacacttattgtaggcttttaaggaagcgctagaaactcctacgtctttccggaaaaacatgtacgtgttttccgaaaaagacgtacatgtttccgagaaaacacgtacatgttttttccaagaagcgatagccctatttattctattacatgccagcatattatgttcaagataagttattgttgttttttgtcgcattattattttatggattgaatcttttggatacctttctggacatccggatggctcatgaaaaggttccacaacagattcgtacggtaattctcgatcataaccgttacaggcgcttgattcaatcccataaataagggagacacccaatttacagtcaagttgaaagcatcccggaaaccgtactcaccccataagaagctgccatggttacgataataattccgcaaggctttcatggaagcgtccggcgtataagggaaagaagccagagcgcccgtaggtgccatcgttccgttatccctgtgcggcatcggctcctgagcttgatagttccaagcgaaatcgctggcggtcaatccccaacaatcttctccataacctacataccccccttggttctcgatacaataccgttgattgatctttgccattttctggttgttctcgaaataattcgtatacttatccgtgaacttatgtgggtccagcccgagataggagtaatggataaagaaaagaggacctccattagagacacctacttgcaagttctccccataataagtattgccattcgtatacatcttaccatcttctacacgcccccaatcggcacggtattcttgcgcatactcctcttggctggcccagccgctataatacatctccggagagattccgtatttcggccccatgatagccaacatataggtaatcatggtctcattccagccgatcaatttatgattgatcacccacgcctgatctggagaccagtgccaatatagatatgggctgtccttaaattgcttataccagctccattccacgtttttccatagattatcgatgctcttacggatttgtttctccttgtcattctcttggttgaaatattgacgagccgttaacagcccttggaataagaaagaggtctccaccaaatcacctccattatctttcgggccgaagaaagcaaccgtcttcccggttgtcccatcgataaagtgagagaccgccccatggaatttatccgctttctccaagaaagaagtgattttcaagaaacgctgtacgccctcttcccgggtgataaatccccgttcgatacccgccacgatcgccatgataccgaagccggaagccccggtagcgatcatatcattccgtccgggaatattctcacgggcaagaccgctgtttggctccgctccctcccaatagtaacggaagttcgcttcctgtaccatatccagcaattgctcgtccgtcattggataggtagtggccgagactgtctgggaatcattggattcattcagcgcataatccacggccgtcaccttataataagcctttttaccaacctctcccaagaaatcggtataacgattcatccaagggcggcggacagcgaccggctggtaagtgatcccgtcgaaagaacggtaaatgcgatagtattttatatcctcctttgattgaggaatccatttgatatagatatgacgctcataagccttagcttcctgcaagaccggagcgtttaaggtacttaccgacggaagggaagccggcaaaagctctatatcgtccaaataaatcgtatattcgtttccatcggccgtaccgggacgaagggctacggccgctaatttcttgatgttcgtatcgttcacggcgtttaatccgaaatccttcaaaggaatggatacggaatgccatacgccgggacgtgtatctttcagataatttctcaggtttaggtattgggtatacgtgctgtccgcataacgaatagcgatattgggaagagcggcagcatccatgctctctctcagttgtacttgtaaagagagcgtagagggctcacgaaagaagtcattgccacggaccgggcaatattgtatctcgctataccaatctccaccgggagcggatacataggtaagctccaaggaattgccgggtgtaaaagcgacagagccggcaaccggaagatgatgtctcgcatttttaatccaagaaggtgaggtatatttcgcttgagaataaaagtaatcccctttcatcaagctattctcgaagaaaacatagtcgtaaggtttctccaccgcttgcaagctggcggataataagagagtagttagtaatgcgatgtgtttcatgatgttgatatttatataaataaacgatatgatttgagataaaataggcggtgccaaacgggttgacaccgccttgccaaactacaaaggtctagtaaataatgagaatcttatattactctgttacttccggctcaaaaggcacaggctcagcttctaagttaggattcaagtcaatttgatcctgtggtatcggataatattcgctttctcctttcacaaaacccggaagttcttgagtggctctgtccgtacggactaaatcgaagaaacgttcgccccattccaatgccaactcaacttgacgctcttccagaatttgatccaaagtcgcatttgcaatcggagctaaaccagcacgttcgcgaaccaagtttaatggagcgtctccattttgtcccttacgaactttagcctcagcgttcattaacaacacatcagcataacggaatacacggatattattattatcgccatatccagtacgtcccggagtcatttgattagccggtgtataagcctttccattataagcagtcggttcacccggttgagcgacaggaatataatcaccgtcacgagtagtggcatccgtcatgaggaacgttgtttccgcacgaaccgcttcaccacgtttagagaataaattacggattttctcagtcggctcaataaatgcccatccagagataggagcctctccacgaggaccttggaacgcaaaccagttgtcagaagaaacgatatcaccacttccatttccaaagtcagtaaattgatactctagcaaagactcattacacaattttcccggaatcttaaacaactcatagaaatcattatacaactcaaactttccgctattgacgatatcctcggtcaaggccaatacctcatcccattcattatcatacatcttctgtttcgctttcaacatctcagcggtatattttgtaaccgctcccggatgctcagactcattcggacgaatagccggtaagtttgctatacaataatccaactcgtcataaatgtacttctttacatcctctttcgtattcttgaatacattcagttcttgattgtctaacaaaagaggcacatcgccaaataaatttaccaactggaaataagcatatgctcggaaaaagcgaacttcagcagcatattgagcgtttaattgcttgtctgactcactcgtcaaatgtttagcataattctctaaagactccaatgctgaattagaagtagagacaacataatagcagtttccccaaaggccacttaatgcccagaaagtagtcaaacgatcatactggaatttactagcatactcatactcaatctggtccgtaggagatcctcctttattcacatcgtcaccgcgaactatgatacatccatacgaggaccaagaccccagataaccacgagcggtcgcatatacaccggaaacaggcatatacatattcgatttattcgtataatcaataccctctacctctacagtattctctggaagcttatccaagtaatcactacaactggatgtcagcaatgaaaaggctaaagggatagcccataaaatctgttttttttaatatatttttcatatacttctgattagcatttaaagattaataaataatacgaagacctaacgtataagaagatgctaaaggatatacacgctcatcaaatccataagaagaagatgctatctcacctttctcgttcttactacccaactctgggctgaagctgtttgccttgaaaacagtcaaaggacgatcagcagtcaagctcaaacgaatgctcggcatcttgaattttccaaagtctttcttcgggaatgtataagcaacttgtacattctgaatacggaaataagaaccatcttctacatagaatgagttaaagttagagatattccaaggttttacagaacctttcgcagacatatattcgttagtagagccctcacctgtccaacgattctcgaactgatctaagtcatagttcaattcagagtgccaacggcggtcaccacgtttacggtttacgatctggtttccagctacaccttgcataaccatagagaaatcgaaattcttgtaagagaatcctaagttgataccgtaattgaagttcgggatataagaacccaatgttacacggtctttattatcaatcttaccatccttattttggtcaacatacttgaaatctccgggctccaaaccatttgctacagcaatcggatcagcagcgatctctgcggcattctgataaacaccctcaatatcatatccatagtaagcattcaactcaccaccaacttgagaaatcgtacggaactccgcagaaccaccatataaataagataaaccattcaaatcttttacctcattgtgcaaggttgtcaagtttgctccaatgtagtaagagaaatctttaccgatcttatcagcccagttaaaagacaactcaacacctgtattcaaaatctcacctctgttacctaataagttaccggcacccattggcagaggagcgtcgatcacggcattttgagtcaaacgataataccagtctgcctctattgtcaaacggctattcaacgtacgaaaatctaaaccgacgttcgtctcattcacgacttcccaacctaaccaactaaaataaaccaagttcgtataaccaggaacagcgcttcctccaaatataccagaggtacccatatcttgcgtaatggaagcgaaaccatcactagccgcaaccttatcgttacctaacttaccccagctcgcacgtaatttcagataatcaacccatttctgatctttcatgaatccttcttctgaaatattccaagcagcacctacagaagggaaataaccccatttctcttggtatttggaagaaccatcagcacgcattgtagcagacaataaatatttgcctttataatcataagatacacgaccgaaccaagaaacaccacgataagtcgtaccgtcatcgccagttttacgtccatccgcattaccttgattcaaatagtaatattcctcgtgtccgcccggaacacctgtagcttctccccataggttacgccagttctcttcacgtacggattgacccaacatcgcagttaaaccatgatcaccgaacgtatctgtataggtcaatgtattatctaaaatccaactgtgataaatatcattcttcttattcaaaaggggagtcgaattcaactgagttccaccaaccaaaaattctggagtataagctcttgtctggataacattgatatcttgactataagccgttttaaagaataacttattctccggcaagaagtcgaattgcgcatagaaagaaggcattacgcgcaacattgaatttttagaatcataatactccgcttgagcaaccggattgtagtaatactcactcaaaccgatttgggcaggagaaccatatttcgtaggatacggattcaaggagctattttcatcatatacaggaataatacccggtgtacggaaagctgctaaccaaacctcgccgtttggcaagttttgcgtagagttgctcaaaacaacgttagctcctactttcaaccaatcaaaagccttataatccgctttcgtacgcaaattgaaacgagagtaatcatttttagaatccaagataccatcttgatacaaataagaggtacccacagaataagtagctttttcagtacctccagaaatgtctaaagaatggttgtgagttaaagctgtatgtaagatctcatcataccagtttgtattaggaagtgttccccaaacatttttagcgttatttacaacagcctgtaaggtttcattacccatctcactgatcatagtcgcatattgctcactattagccattttcaatacattcgtagccttttgaaagccaacataaccatcataagtaaccgtagcaggacgattcaacgcacctttctttgtcgtaaccaagactacgccattcgccgcacgtacgccataaatagaagcggcagaagcatctttcaaaatagacaaatcttgaatatcactattattcaagaaatcaatattatcaaagaacattccatctacaacatacaaaggttggctatccgtattcatagaaccgataccacgaatacgtacggaaggaccggaacctggctggccactattcgtaatctgcacacccggcacttttccttgcaaagcactcatcggagatgatgtcgcatgtttcgtaatctcatcagccttgatcacggcaattggagctgtcaaatccttagccttactcgtaccataaccgataacgacaacctcttccaagttttgcgtatcctcactcataagaacatttactacagtctgtccgttaaccggaacttcttgtgtagtcatacctacataactaaatactaaagtcgcattcttgggaacattactcaaagtatagtctccatccatagaggttatggtaccgttagtcgtacccttaaccaaaacactcaccccgatagctgggtatcctgtggccttttcagttaccacaccggtaactgtcagattctgcgcaaacattgttgtcgcggcaagtaacaggcataaacaaagcattaatttagctttcattcattctagttttaaagttgaacatttgtttttacactcattattaaatttgaagcaaatgaacacccaaacctaaaaaagggcaaatttttgtatacttcaacactactgcaagccttgcgcaagcagaaaattactacttttatactactgcaatacatattaattatcttattttcagttataatacatttgttaattcaaaaggagaacattatatgttattaaacacatctcactaaatatgggaacacaaaaatgacaaggaaaactcatagttatgattttcttatttcatagttatgatatttttcattcataactatgaaatttcttagtggaactggatcatgaaatctaccaagctttgcccctccggtagatttagttttttacgcaatcgatagcgcgccgcctcgataccacgtacggaaagattttgcatacgagccatatccttagttggcatattcaaacgtaataaagcgcataatcgtaaatcgcccggagtcaaatcgggataccgctcttttagattcgtaaagaacttttcgtggatacgatcgaaattagtctggaaaatggcccattcatcctcgcctgatatattctcttcgatcatgcggatgagcttatcgaagaatcgtttcgtataacttcccgataattgttgagcttgtatttccttttttagaccttcaaggaaatcattatgagagataacagacaaagtagcactggctaattccttactcttataagtaaggtcattttctaatttttcattctctagcttgacaattaattgctcttgcgccctcaattgctcttcttgcaatctcttttgctcctcgttaacttttttctcacgcatgacaatccacatcgtatacattctcactaatacgaccagtatacataaaaacaaagcaaaatagatgatcagcgcccaccaagagctataaaatggacgttcgatcttgaatggataagacagagaagatagctcttttcctcgatcgtctttcacaaccgcatgtaacacaaaattaccatacggtaaattagaataagtccgttgaaaattactggtgccttctatccattcattatcaaacccgtccagtttataatagatcaggaaacggcgccccgtaaaatccggatacgaaaacttaaaaagaatcgtattatagctataactcaatacggacgcaccggaagccggtgcgtccgctcccttgcaagggagcggagcgaactcattttcatgccgattataggcccttacctgcgacaaacttaatggaactcgagtcgtatccacataattccggtatctgtcataacgagcgatccccccgtttagacaaaaataagacgtcccgtcggaagccacataaatatttcccctatcctctatggtcggattatcaaacaaagtaaaaggaatacgctgttttaactggaatcgcccagactcatatcctaacaatacatattccgaattccggataaaccaatataaatcattattcaaggaaacaacccgataggtatcgcttaactcgggaaaatcctcattcaacaaatcataaggaacgatctttccagtcaaatcctcataagtataaaacttactcccatccgagaaaacaatacgtccgcgtaatttcattacattaatcgtaccactctcattaccttcctccagttttccgatatactccatctctttcacgctcctcaaatcctcattcaagcgaagacgatagatacctttatacatatggctagcccatatattgccggtagggtcaacctcaaacgatttgatcaaattagagaatccttctacattatggctaaatttccaacgattagtaaccatatcccgggtgaaaacactgagtggacggtaagacatctggagtaaaacttcctttccatggataattgtcttacgtaatgcggtaccccctccattgggccccggtatctgagtagcttttcggccctctagctgtaaggtacctgtattatgtccggcaatcagttgatttccgacatcggagatataccatgtctgttcttgagtaccgggaatcaaggttggataactatcattctcagataacgcataaagaccttggttcgtagctaaataaacaatacccttctctatcaccatatcatgcaccataccaatctgggcctcaagcggttcataaaaatagatcggagaattcacatgtatctgcgcgataccattatccaatgtaacccataaattatccgaattatcagcaaatactctcaataccgtattattaatcaagccattctcccggttgatatgccacaaagtttccccctgcttattaatcgctacaaccccattagaaatcgtacccacaataaaagtagaatctttcatcatgactccccggtttgcgatcccttcctttaatatctcattggctggtgtattccacacagacaattttttacgcacctcatcatagataaaacatccactacgagccgagaccaataatagctgatgatcaaatggcaagaccgaaaccacatcatcctccaaaacctttttcgatagtaactctgtaaactggccgtcatccattcgacaaaagcttcctccctccatgaactgaacgtatagatgatcgtctaatgtgaaaatatacaatggagacaggtcggatacaccttttcttactttttccccgtcataaataaaaaagctccggaatgattgaaaataaatctcacccttatattcattaatcgtccagaactcatcattattaagatagacgttcatctcagacgaactgagtgaatgataaatcagatcattctcgtcatccatctcaaaatacccgaactcctcgaaagagccgacataaatacgtccgtccttcgatatatacaaagcacggacacctagattattcggtaatttcacaagatcccagtgaataccgtcaaaaaccaaaagcccccggttattcccaatatacatctttcctcccggaccttgggagacggcccaattctggtttcccgctttgtaatcgcttacggaataattgatgattttaggaatatagggtaccttcgcattccccgttatacaaaacaacaaggcaataacgcaacaaatcaacatacgaaccaacgtcctcttaagtatctccttcactatatagtacagaatgttatgtaccacaaaagtaaataaaaaaacatcacgttacaccctacttcttataaactctcacataatcaatctcaaacacatgtggaaaaagagaatcatcaatacccttttggcctccccaattcccaccgatcgccagattcagcaagatatgaaagcgtttatcgtaaggccaaacctcatagcctgtcccctcgttcttaaatgtaaagtataattgatcatctacataaagccggtactcatcttcctcccattccaaggcatacacgtgaaacgctttataacaatccggacacgcaattttagcatttttttgagttccgatcgcatgattatatttttccgtatgcgaagaacctacgatcgtatcgggatcatagcccacattttccataatatctatttccccgctttttggccaatccccgtattcccaatccgttggaagcatccagatggccggccatgtccctcgtccggtcgggagtttcgcccgaatctcaaaacgtccgtacaaccaatccccttttcctttcgtaatcagacgagccgatgtatatgaacgaccttccatcggttctttcaaggccgtaatcctcaataccccatccgagacccaagcgttctcctttctgccggatgtataatattgagcctcgttatttccccattgatatacattaccttccgtatcataagaccatttcgtagaatcaggaaatcccgtatagtcaaactcctcactccatatcaatttccacccgcctttatccatgggtgcagacaaatcgatatcactagcattcgccagactgctcaagaaaacactatataggataaaaccaaacaaaagaaatgaacgtgacataacaatatagattaagatataaaacagaatttccgcaaatgtataaaaatcacatcaataaaaggtcataaggataaagtcttttacactttatccttatgaccttttacaaatagtcttttaaggctataaatgaatcaatatcccggattttgttgcaatttattatttttctgcatttctaacgctggaataggaaatattcctttataggctggagttattttatttttctcccaccaagttcctgtaaagaaagtcccaaagcgtatcatatccgtacggcgatgatcctcaaaaacaaactcttttttcaactcatcctcaattgtttgtaaggttattgtttctggggttccggtaataccggcacgggaacgaatctgttctaagaaaggacgcgccttctccggctgatttaagcgcacataacactcaacttgcatcaataacacctccgcataacgcataactactaaatcatgatcacgttcccattcctcaccatctttttgctcatatttacaccaatgcactccctcataatcttttgcgtccatgatatcaccaatctcatccgtaaaacttaacggttgaagtccctcctgattcggatctcgatcaacaacttccccagtacgaagatcgatctgatcaccgatcaacattgtattacggcgtatgtctttctcatcgaagctatagtataatccgggttgagccacaatactattaccacctccctcaaaagctccagttgatgagattgcccatctttgctcattatgcgttaaggcccaattcaagaaattgccacttgtacccattttatggtcataaggtatagctaataagatttccttagaaacctcattctctgtctggaaattagtaaaataatttgtttccaatgagccagatatttgctgacaagctttaaggcaatcctcccaacgggattttccagaaaagatctcggcattcaaatacaaacgagctaataaacaataccctgcgttcttagtcattttgccatagccggattcaggcaattggtcaataatagctaataactctttttccgtaaaatcaaaaatctcagccctcgttgagttcgtcggtaatgtcagatccttatagtccgtaatcaatggtacatttccgaaccaatcgatcaagcggtaatagaaataagcacgtatagcccgtaattcagcaaacatcttatttttctgttcatcctttaaagaagacccttctatttgtgagataatagcattaaccgtcgagattccattataacaatatctccatgccccagtgatagccacattctgattatcccactcatgacgtttcaactgaacatatcttccgccatcataccaatcggcacctccattccgagccggaagtaccgcctcatccgagctaatcgccgaaataaaatagacatactcactaaaagcatatccattcgcaccatcaaaactgcctccacggagggaagcatacgcacgtcccatgatagaagcgatttccgagtccgtttgcccatattcatttgcatttatcttatcatacagattctcggacaaatcggtacacgccccaaacatcataagtaacccagccgctaatattgattgtattttcataattctcctgtttttataaatgattagaatgatagattaagaccgatagaaaatgtcctcggcatcggataaatattacctttatccagtccaacttcctttaaatctgaagtactaacttccggatctatccccgtataaccagttaatacaaacaaattctctcctgtagcatagaaacgtaaacggttaaccccaaaattcttcaggagacgagcagggagcgtataacccaaggttacactttgcaaacggaagaacgaaccattttccaaccagaaatcagagtaaaccggcatattctcatcagagataccactttcagcgaaagaggaagtgatattataatttggcatatgggccgtataacctctttccattcccgctacattcagtaccttctgaccatacataccataaccagagatacccaaatcaaaatctttatacgtaaaattaaatgataagcccatcgtcaattttggttgggcgttacccaagatctcgtcttctccatcatttgccaacacgaatttaccatctacaataccctcgcaatgaggcccataaaatgttcctacaggataaccttcctctataacctgcgaataacgattagacattcccaaaataccttgtagcgaaccacttaatattcgatcggtttgataaacttgattagatagtttatcaattgtctgtttgttatgtgccaacgtcaaattagcgtcccaagtgaaatccttatgattgataaggtttgcccccaaagtcaactctacacccttattggtcaaatcacctacattcgctaaaatgctagaatacaaataaggaggattaggtacttgatacgtatataataaatcactagtctttttcaaataccaatcgaacgttaagtttaaacgattgaacaagaacatatcgacacccacattcgtttgggcggtagattcccatttcagatccgggttcgggttctgagtaaccccatacgattgtttccaagaattactctcgctatcaaaataagcaccgcctcccgtacccatcagcatagccgatttatattctccgatcccggattgatttcccgtcacaccataaccggcacgtaactttaaattagcgacccaactctgtaagtcctccataaaagcttcctccgaaatacgccaagctgccgatacagacgggaatgtaccccatttatgattagtaccgaaacgtgaggaaccgtcacgacgaatcgtggccgtaagcatatatcggtctttcaacgtataattagcacgggcaaagaatgagatcaatttcgcttggctcttagaagatgctacgtcctccaatcggttatcctgccccgctcccaaattattccataaaaaatcatccgtgtcgaattttcgtctttcggctttcagagtctcaaacgaataatccagataagaataaccaaccatagcgcctatacgatgtatcttattgaatgtcttgtcatagtttaaaaaaacctctaactgcttattcgtatattcctcgttatatctcttagcgtatccaccatctgtaactttataaacataagacggacggtaataataatcttgatttgaattatattcataagataaattggtggttgctttcagtccgtcaataatggatagttctaccttaccgtaaccgagtaaatgcttacgggttgtctcatcatttcgttccgtatggctctccaccggattattttcagtcaatcgtccaccgacctgctccaaataattcccattctcatcataaataggggctgtcgggttcatattataaatcgtactataaatgcccttatccacattatgccgtttatctgcattagcctgtaaactcaactcaactttcaaccggttattaagtccatattgataagcggtcaaactagcactcatacgatccaaatcactaaacttaataataccctcgttccttaaataattcacggatgcacgtagcccattatcttctccaccggaagagaaggaaagcgtatgggaatgagaaatagcggtttgctggatcgctttctgccaatcggtattggcaccataatctacggcatcggtcaaattatgatcacttacatattgacgccattctccagcagtcaatacatccaaattattagcgctctttcctatcgctacatatccattgtattcaatactacgcccttttttctctcgattggtcgtaacgataatcacaccattcgctccgcgtgaaccataaatagccgtagccgaggcatctttcagtacatccatagacaggatttcattgggttggaccgtactgagatcaaccccgggaataccatccaccacaaccagtggcgcattactggcagacaaagaggtacccccacgtaaacgcatggaagaacttttcgtcggatcaccaccaccttgtgagactaccaaaccagcgaccttaccttgtaacaactgctccgcagaagaaatcacgccttgcttaaaatccttggccgaaacagaagcgatagagcctgttaaatccgatttacgagaaacaccataaccgatagcgacaaccgttacctcatccaaaccgatagaagtcggtttcaattggatattcaactgtgatttagcttccaccgattgctctgagtatccgatataggagaatgttattaattccccctccgttgcctctaaagtataattgccatctatatcggtggtcgtaccatttttagaagcggtaatgatagtaaccccgatgatcggcaaaccattttcatcagtcacgacacctttgactgtaatatgtttttgtgaaatctgggaggactggtttgtttctgccttatccgtttttcgataaagaacaatatgccggtccgttatcttataagcgatatcattacgatttaataattggtttaatacctccgtaattcccttatccttaacatggatactaatcctttggtccgagcttacttcctcctcattataaaagaaagaaaattcactttgctcctcaatcgccttaaatgcctgttcaatcgttacatttcgcaaattgaggttgattgcagccgtatccatatagctagcggcgaacatcgacgttgccccggttaaccccagacttagcataaataccttgaagaaatgttttttcatttgttaatgatttaatttattaattatgcttttgataattccattcctctcattgacttatttaatattagatccggatctttctatttaaggtcactcagaatattgttatctccattcatagtaaagagacaaaaaggattcgatacgcctaaaagaaaattaaaaaaaatcagtacatgatctctgtattaaccaaaccgaaataaactaagccaaacaaaccggtattccagccttggatatgataacctaaattctctcctgtcagactatttatatgttcattaggtgaccaatcccctgagtttactaaatccgcacgtcctactttcttaataatatcaatagcttcctcttgttgtcccatattaatacgtgcccaacagtccataaaacttacccacggccatacacctccattgtgataagtagccgaaggataaccaaaactatcatcataataaggaaaagtctcggcaatcccgtaaggtgtcatacttttcgtatttaaagtctctatgattttcaaggctcgttcccggggaacaacatcaaataagataccgatcgtttgatcctgtaaaatcctatcatttacgctcccatctttccatatctgacaataatagtttccattccacaagcctccttctcttacatctttattcatagtcttatatcctttttgataggcagattggtaatagttagctcccgcttgatcaccacactcttccgccaaataaaccatttcctttaaagcagataaataaatcaaacaggtaaaaggagaatattttcttccctcgatccccttcacatctttccaatctccccaaaaagaaacctgagcaggaagtccaatcttatccgtatctctagaaatcaaccagttcatggcatttttcatagctggccagtagttgatcaagtcttgtttattatgataataccgatagaatctagcaatacgcaaaataaagaaagcattgatatccaaatcatcctcccgctcaattagaggaaggatcgtagtcggaatcttcccggacggttgttgccactcgatactttcctcaatcatctttctctctaaatctttataaaataccaaatgcagccaacttgtccaataactatcgcgttgatttaactcacgatatcccattgtaacaagttcccctttttttgtccatttcgtaagtgatacgcccggaatcatataccatcgcacgtaagtatccaattctttatcgcctgttttgggaatcgctaaactaaaagctgttgttttatctttaaaagccgaccacattttatatgcataggccgaaagatcatcaagtgtccggaaattaatactactgatccagttatcatcccgaaaagtaaataagaccttgattttctttttctcgccagccaacaaagaaactgggatagaaagtttttgtccagcccacaaactttcggtttgatcagtcgtaatttggcaattatttttgttactaatgcccgtatattcatcattctcactgaagctcatatctttcgctaaattctcgtccggttgagcgaccagtgtaaaatgctcttctttagaagtcggattagaacaacaaatctctaacatcaaaacagggagagcagaagtttccgcatcattaacccccaatgggcaaaaagcctctgtagtaaaagtcacttttgtgagggacgatcctttataatcattttttacaaacggaaattcccttatgatattctttttaggaaattcagaaaataactgtcgcctaccatctttctcaatcgagaacattacggcacctctgttagttaaccaatcccctaatgtcccgggattttgcataatctgtccgaagaagtctccagatactgaggcattaacagttaacgcaaagttagcgatcggatacccatcgacaacttgccttttttgagcgaccatagaatgactaatcatccaaaataaaagaaaaaatagagaatgtgttttcatgctattcattgaatcgtattcttttaataaattgttacttgattatcaactattgtatattgaaaaggtacattaatccgtattatattgaaaatttgtggaagcgtttcattattaataaacttaccggtaaataccttatgttccaaaccaaccttctcaatcgtgatcttacaattgaactttctttccaaactcttacaaatattaccgaacgatttcttcttaaaaaacaatttcccctcagtccatcctatagcatattccctttcgaatggctctaactgaaccaccttcgtgttcttatcatatacagcagaggtactaggcgtaagatgataatgtttattatccatattattctttatctcgacagatccggatatcaagcttgtcactacctcttcttcctctccataagccgatacattaaaaacagtccctaataccttaacatctatttgcctcgttttgacaataaacgggacatgttcattacatgcaacctgaaaacaagcttctcctaccagtctcacatcacgggaacttttattataatccgtagaataagaaagcctgctcccatgattaagggttaccacagaactatctggcaataccacttcagatacgccattttgagaattaaaaacaatccattcctcttttacatcagaccgaggttttatcgattcaaagagaaaaaagcctattaataaagtgatactggccgctatagacaaaaacagatatatattttttatggaaccctgcttacttcccttatccttaaacatcttatgatatagctcctcccgcacaccttcttttatttctgaggcatgcccataatcacagtcaagcgagatatgatctattatcttgaaaatcttttttttctcctcatccagcacatctagcgcatcagatggaagatcatcgttttcccggtttaatagacttgctagtttttgccattctttttcaaccttaaccttcatatttcatttaatttttttacctgtgcgatactcctgtatgactattccaattttccttattgctatgcacatctgtgcgtgtaccgtccgatccgatatcgaaaggatctgagccacttccttgtaggtcatattttcttctctcaccataaagaaaattaaacgacacttctcaggcaaagagtttatcgctaactcaatgattttctttaattcattgtccaagatctcttgttccggtgttgatttctcagacagacctcctaaatcagcgtcttccaaccgtattttctggtacttatcgctctcactcttatatttaagagcatgattccgggcacagataaatagatagttctcataattctgtatttctggcaattgctttcggttttgccacaaatacaaataaacatcagaaatcacatctttacatacacctttctccacaagaaaatagcttgtgtatctatacaatttcatataggtataatcaaaaaacagttggaaagcccttgggtcatcattcgcaatctgtttaaatagagatcgtatattaattgtttcttccaatggatgtgatgtaaatatctattttatgatgaagagaaaaaaagagtgaagtatgcctaaagaagcagattgaataaattcgcatttagggtttattaagagatcatgacccctacttgcttatatccgctagggcattatataataaaaaaagagatgtcaaaattgacatctctctctggattgttgagttgtctcacgaggattcgaacctcgacagacagaaccaaaaactgtagtgctaccattacaccatgagacaatccgattgctttactaaagcgatgcaaaggtaagaataaaatcttaccttgcaaatttttttgattatttttttactttgcgatcaacaaataataatttttcttacctctttgaaccaataaatacttatcgtcaagcagtgaggaacagtcgattacagtatcaacctccgctaatttctctttgttaaaacttacgccaccactttgtaccaatttacgcatctcaccttttgaagggaagatagcggctttttcagtacacaaatcaacagccttgattcctgcggccaattcatcacgggagatatcgaaatgaggaacaccctcgaatacggctagtaatgtgtcctcatccaatttcaacaaagcctcgtgagtggagttaccaaacaagatattggaagcctcgacagcggcctcataatcttccaaagagtgaaccataacagtcacttctttcgccaaacgtttctgcaacggacgcaaatgaggagcggcctcttgctccgcctccaaagcggcgatctcttcttggctcaagtccgtgaagatcttgatatacttggcggcgtcagcgtcgcttacgttcaaccagaattgatagaatttatacggagaagtatagcgacgatccaaccagatattaccggattccgtctttccgaacttaccaccgtcggccttcgtgatcaacgggcaagtcaaggcataagcctcccctcccaacgtacgacggatcaattccgtaccagtcgtgatattaccccattgatcggtaccacccatctgtagacggcaaccctcatgctcatacaaatacaaataatcgtagccttgtagcaattgataagaaaactcggtgaaagacatacctacactagattcgcggctcaaacgtttcttcactgaatccttagccatcatgtagttcacggtaatatgcttaccgatatcacggataaaattcaagaaagaataacccttcatccagtcatagttgttcaccaacttagcggcattaggagcgtcggagtcaaaatcaaggaacttagccaattgtttcttgatgcaatcctgattgtgacgaagagtagcctcgtccagcaaattacgctcggcagacttcatagacgggtcaccgatcataccggtagcgccacccactaaagcgataggacgatgaccggcacgttggaaatgcttcagcatcatcacacttactaagtgtccgatatgcaaagagtctgccgttgggtcaatccccacataggccgatgtcaactctttctgcaattgctcttccgtcccgggcatcatatcagcgatcatgcccctccatcttaattcttctacaaaattcatcgtattaatttatatcgtattacattaatatatttgtcactttatctcatacgaggcaaaggtacgactttttaattgagaatcgaaaattgataattgataattatccgtttaggtggaagatagaaacgtttttagcgatttgaatccgcagcttttcttccggaatatccaacgcttccgctacattttggtagaccccgcggatatcaatcgatttatcatcggtctccaagaaaaggaaatcaggccatgcggcacgcaaagccgacggattaaaacgatctccaaaagagagataaaaccccaagcgaaccaattgggaggcaagttcaccattacctcgaaagccatggataatccaaggcatctccggtttcacggcctttttacaggcaatgagatccgcccacgcttttacgcaatggatgattaatggcttatgtgtttcctccgctaaattggcttgtgccagaaacacctctttttgcaaatccattggagattcggccagtgtatcaagtccagcctctccgatcgccacgactcccgaaccagacaccaataccctaagtagatctatctgctcctttacattatatatataccacggatgaataccatatgagcgaataaccgtatcaggaagtgaacccggctgcatatcacccattggactcacgatcctatttataatcgcgatatcctccttatggaaaggcatctgatgcgtatgtatatcataataacccatggcgttacggaaccggatcataaccgctcccaccccaaggatggcaacgaagtattcgtttaaccgcaagatacaatcctttcacagggccatatttcttcaaggcttgcaccgcatattcggaacaagtgggcgtatacctgcacgaagccggtgtcataggagagatacaatatttgtagaaataaaccggcaataagagtaatgtggtaaaaaagcgtctcattattctttatcccgaaggatatggatcgctttcttcattgccttttccatcacagcgtacggatggatctctttatcgaggtacaggaaagcgattaacatgcccttattcttcgcttccaacggttccagtaaatcatatttacgaacccggtaagcctcacgtacctgtcgtttgatcaagttacgttttacggctctcttaaatcttttcttcggtacactcactaagaaggaagcacgggcaggcatctcttcctccatcggtaaataaacgacccgcagtggaaacgccacgaacgattgtcctttttcgaataataggtcaatgtaacgtttccacgacaggcgttcttcttttgaaagggtatacctttttgtcgtcattattttttaccgtcttgctgttttttcagatataaatccaaagcagcagtcatagaaggggcttccaccgtgggagcctcaacgtccaaacgcagacccgcatctttaacagcctttgccgtagtagggccaaaacagccgatctttatatcgtcttgtttgaaatccgggaagttcttcaataaagaagagatacccgacggactaaagaaaaccaacatatcataatcgaatttctcgtccttcgcgaaatcattgctcaccgtacggaacatcaccgctttcgtatagttgattttcttcgcatctaacaaagcgaatagatcatctttatgtacatcggaaacaggtactaggtatttctccttcgcatgtttggcgataacagtcaccaaatcatctgccttaccggtctgaccataaaaaatcttacgttttctataaacgatatacttctggagataaacagcgatcgcctctgtcatacagaaatacttcatcgtttccgggatagccacacgcaattcctcgcataaatgaaagaaatgatcgatagccgtacgagccgtaaaaataacggcggtatgatccaaaaccgagattcgttgctgcctgaactccttggaagataaaggttcaaccttgatgaacgggcggaaatctatttccacaccgtatttttctgcaatatcgaaatatggtgatttctccgatgcaggcttcggttgtgataccaataattttttaatattcaatgccatagagtacttgactcgataaagttatacaaataaataatgccttcatacagaaaaactaaaggcaatatttcttggccgcaaaggtacaaactaatatataaaaaactgctatttttcctgtgaaatatccgtatggtcttataaattatcacaaaacgacacagaatataaaaaaatacaaacaacaaaacaggaatttgtatactgctccccacgaataccaaccaaagtgccggaatgtataaacagatcccccacgctcctataatagcgttataattagtcttccaaaacttgtatttcggagcgtccgtaaaaacaacccccaataaataatagaaacagcgcttacaccaataaaacagcatcaataccatcattatcaacccaatagatatcaacaccgtattttctagcaaatggttgaaatacccatatgccttagcgatagcaaaaagacaaacgctacaaagaaacaaggcttgaaacgtcatgaaattccggaagagccattcgctccccctcgttacctcaaataaattttgacgttctttcacatataccacatcacgcatcatcttcaggaataaacgataattggtacggaacaccaacgcaaaacacataaataagacgaacaaaaggctaaagaccacatcgtccaccaattgtccgtcccacaaacgaatccctacatatccttcaaatgtacccatgtgccgctattatcggcacaaaggtacataattatttcaataaagcgcttccttaataatctctcctaccgtaggatgcgggaacacaaacgactttaactcatccgatttcatccccttctcaatagcgattccggcgatcacgatcaactccgaggccggattacccaacatatgggcaccgatcagcgtctcatcctccgacaagatcaacttacaaacaccattccccatctcattctccgcgacaaaacgcccagagaatgccatcggtattttcttcacggtatacgaaataccttctgcctgcaactcctcctctgtcttcccgacaccggcgatctctggattcgtataaacgacacccggaatagccttataactcatcgggcgcgatttgcccaagagatgatccacggccacctccgcctcgctaactgccgtatgcgccagtaaggaaaaagcggtaatatcaccgcaagcatatacatttggcagggaagtctgcatgtactcattcaccttcaccccattacggaaaggctccggagccagtgtctccaagccaaaacctttcgtaaccggacgacgccctacactcaaaaggactttatcgccatgcaacgtgaatgtctccccgtctttctctacagaaacctcggttccatgcaccccggtcactttatgacttagatagaacttgatcccccgtttagtgtattccgcttgcaacatttcggacagctcacgatccatcgggcctaatatcttatccaacatctccacgacatgtacctctaccccaaggctattgaagaaagaagcgaactccataccgatcacgcctccaccgattatcaccaaagaggccggaagctccttcgattgcaacgcctcccggctcgtccaatattccgtctccgccaatccgggtataggaggaattatcgtttctgatcccgtacagatcaaaaggttcgcagcctcgtatagctcttctccggcggcgatcgtaatcgtcccgtcggccgcacgcccttggatacaagcttccgccgtaaccatcaccacgccatgctccgtcattttcatacggataccggctgtcagctttttcacgaccttattcttacgggcgatgattttcgggagatcaaaagaaggattctccgctttcaccgcatacttggaagcatgcttgatattatcatacgtcttagcggaataaagaagcgtctttgtcggcacgcatccctcattcaaacaaaccccgcccaatgcgtttttctcaaaaagaatcgtggaaagcccaccctgcgccgctctctccgcggcagtataaccggcaggacctccaccgattatagcgacatcgtatttcatactattagatctatttaagttgtatattaggatttatctttctcaactgtttgataaaatcagcccggttggtcggagatatgagcatccaaggtttcccattgctccatatgatcagccgatccaacgaaagggcgtagctggacaccggcatcacggtagattccaacgcctctatatcagcgatagcgatcttcttctccgggaaaatactacaatgcgctatcaacacatcatcttccgttatccggtaatacgtattaaagaaaacatgaagcacccccaacgcagcgaccatcatacccactatagccgatatattggtacgcaaaaacgcagccacacaaccaattaccaccatgataatcaccagatgataccaccatcccacttttgatttatattctctttccattttccgaaatttgccgcaagttaacgaaaaacgtcaaacaaaaagaaaattgcccaatctttcctataaaagaaaatacgctgtcacttctcagcaacagcgtatccacttaaaccggttaatacaaatcataagattgtagtcgccttttttattttaattcttccaataccgtataggattgtaatacgttattcttatcatattgttccgtacgcactaagcctacattcgggctgtaccactcatagccatacccagtgattgtctcctttgatttaggggaacgtgtagcgatattatattttaccttagcgcaatcgaacgtaccggcaggagttgttatgctttccgttttaataaactcacggtccttaatggccatatccttacgattcttccgattcttcttatcgtagatctttacggaagcctcgtcgaaatacacgttattcttatcgaaattagccgcatacggatttgggtaatttataaagttctccgtgatatccacattcgtattcatttccgataccactcccggataagagagtgtctctttcgagtcgaggaaaaattctccattctggcagtatgccttgatatctcctttgttcacgatcgtaccggagggattagtatatacgtagtccgcttccacctcttggccggaaggcaatgtttccacctcatccacttgataactcataacagattgtaagtttcccttcgcgtcatatcctttacggacccataccgttccctctgtttgcggaaagaagaacgtacaatcttgcgccatcgctcctcccgcgatcaatgagattaaagccgtgtataatattttcaccttcataattttgacgtttaattaattcactactaaatacatgccggatatccaatgctttgttagaacagagtgaacccctaaatgttcagaaggtaaaaattaaaaatagccaaaatatcgtaaggcagcggtatatcatccactatcaatggataccgaatatagcatcttttacgacgatagaatcatttacatcgtacctattatataaagtcccttccatctttccctcaatatatggcatcatggacgattcatggtaacgaacactatccacatagaccttaaacggtttttttaaaggacaatattccaccttatttagtgaatccgttatccggatataagacgttatctcctcttgtgtccgaatccccttctctatattatattctccttcttgtaatgggagcaataccaccttcatcgcataacggcttgaatgttcgcgatccagtggaatcgtccaatgcgaacatctcaagacctcccattctcccctccttacttccgaataaaatccagcatctatatatctccatgaagccgacttattcctaatagaaatatcctgtccgtttaccgccccctcaaaatatcccagataatagggtgtttctttaggtgtatcctctattatctcttctttctcgcaagagataaacgccaactgcaaaagaaatagtgaaaaataaattaggtatctcataacgcatatattttagaagtaagacacttatattcagagctatttccaaagatacaaactttatccggatttcaaactaaaaagacgtagaattgaagttctataaaccaaatacacacaaatcacttcctacatatgtacgaacctctttactatacaagtttccatatattatattatcagttacatttttcttagataaattcaatccccaatgatatctaaacattaacctattctcgccttccttaaacaatggggatgatacaattacggggtagttaatctcatagactaaaccggacggtatattttgtaactgatccgattttcccttcgacaatatgaaactaggaggcattatactagaactcattcgcatagatttttcgtatatcataatcactcctcccggataaaacagcttatccttatccgatatattcttaaatcgcaagcttacccttacagtatcacccatcaaaacagtgtctcgatcagttgcaatcacaaggctcatattttctacgatattcccatccggcaataatttatcttgttctttctcaaacatcaatgactccgaataatgccattgtccactgtccttgcttcttttaagaacaaaattatagaaacttttagcggccaaatctccattttttgctgagatgaacctaaatgattttgacaattcctgtatagtattcctatcctctccatccatacctttctcccaagaagacgagctacaataaggtatcccattctcatctatcaaaaatgttataaaaaaatgggtatcctcataattaatctccgataacttctcacaaatcaaatccgcatatttaccggacgatctcatcaaaactggtgggacaccccaccatgtcactagatgattttccatccatcttccatacctatcgtaatattctttatcacaatcagaagaagtgtcttgagcaaatgcagttacactgatagacaacatcatccataaacatcctattttcaacatcttgataacattttttcgtcaatactagaaatggaatcgtacccccgcatcaaaagtcaaacgaaataagccagagtaatctcctttatcgtaagagacattctcttgcttgggtaaggaacctcctacataaccgatattcaagcccactcccacatgctttgacaaaagatattctgcgcctaatgagaaattatatcctacaccggataaggactcgcttatccccctcgccgattcccggtaactaaaatatcctatacctattttctcttccacgatccatcggtttatgatttgtttcatcacaaattgaggagcgacataagtaagccccacgttaatatctattcccgaataagtataagacgatttatatcccgaatacaataagccagcaccgaaaccgctccttgatatccaatcatacccaacttgccaatccaatccgtttttaggatggccagacccacccggtggcaaataaaatttactggtcacaaaagcgtaacctatattcgcataaatcgtgttatgctcaaatgaagacttctccacgacagcctcttcctccaaatccaaagctttcgatagaggagcggcccgaaacgccgccgtgtccgacactaaaagcatactaccggctatctgatggcaactactacccaataatgaaggtttccgatggtctgtcaacgccaatgcgttacctcccgcttttgccgtttcttgtttcgccaaccaaacaacctgatcataattacatttagtagacactccgttatccactacagaaacattgccgatcctctctgccgaggcaggaacagcctcccccagctcatacaaacgaaccttatccgcagttacgcttgccgggtaacttttagagatatttgtaatgactttgggcgcacatcctgtcattagaaacagaaaagagacaaataagacagacaaacatttaatcattttcatttttcatttataagttcaacatccactttctaaactcctcattctttctaagtacctagatttaataataaaacgtgcttagccacaaaaaattatttatcacaaaccattctatccaaaccattgaacaagcccttaccttttgctgtatgaaaccaacatatcaatatacaaaagttcaaacaaaaaataggctgtctcattttccatcacgaaacagcctatttttaaataaaccccttcttattaccgcttaaaatcaagagaataactctgcatacattttgaggtagcgctcccgaaattgcaacgctatgccttttcccatcgctccggcgcaattacaaccatgagcgtaactgcgaactccattcagattgaatatatcaccttgctttataaaattaaccataaatcacatctatctaattttctccaacactccatcatcaaatcctacagttatatacttagtatgtaataaccaagcactaaccttctccaatgaaataatgtccaataagatcgtaattacctcatttaagaacttatccggatccacatcaacaccttcaatatttagatacttatcgaccggctcataatcaacatcacaagcccaatcatcatcgtccacatcataactttcagagcctatcaaataaacacaatatccattttcagactcaaaaataccaaaattcagtgctactatattttctggtatcacttcattatggcttaattccaaaagccagtcttctatctgtttcttcatagcatttattcttttaaaaatacttcaaacatataaagcacattcgataaattaagttaacacaaaatttatttcattaaatcaacgacatccattattcgttttttatctttctctgaaaaaataaaacatacagaatgatcattaaaaccagcccaaaatgaaagagttattttaattattttcaaatacattcttaagtcatactcatctaacaatgataaatcttcatgtattattacaatatcattattagatatccagtcaaaatccctataaacttcacaaagagcatcccaattttctccaaaataattaggaaacactagagcttttgataagttaaggaataaatccattttgtctcgtactttatatacatatccaataaatgtatcctccactagatacattctaggatactttacaaaaaatatattctccatctaatagtagttttagaatacaaatgaaagaataatattatatattcacatacttataacgaacttttttcaaaatttgatttgaatcattgttccataatgatctggagtaaaccacatcttacttcctcctgtgataactctcataggccctgctcctcttgtcaaaccaggcgtaggatgaacatactctttataaacaccatttgataaatttggcaactttccttcattattataatagatcgccccatcatgacgaaacgtaaacaactttccagaccgtattctatcaatagtcggttgtaaatcatgagttaccccatctggagttgtcacaaaacgagtcgtacccgaagattgactagaagaagcgacctgagatgatgtctctaccggatttaatttaggggtattactaatatccggttgcgtcacatttagcccacttcctggagcctccatcaacctcatctccggtgccggtcttgttgccgtgttcttgaacgagaagattgtccgtccgaatttaacgtccttacctgtccagaagttattacctttcaaggcggcaaccataccgtttccgattccacctgtcaaggcaccacccaaaatacccaagccataatccttcaagctcataaacgggtccccgaaatacaacgagttacccgcactttggacaggcatcatcaccgccgtactcgccgaacctgcggcggctccagccaaaaagcctccgattcccccggcggcacctccagcagcggcaaaggccaacccaccagtcgcagcccccaaacctccggcggcggctccaataccaaatgcggcaaatccatccttgaaactatgaagttgacccgatacagccttatagatcaaatttgctgttcctccgataaccgcacctattataatatggataaactctccatcctcgtccacatacctcaacgggttgttcatggcatagctgtaacgattgaagttctgggacaagtccggcatctggacaaacggatcaggagcgaggaaacgacccagagccgggtcatacaggcgggcgttcatatttaccagaccaaactccttaagatgttcatggccactgtagccacgaccaaggaacaactctacctcctgccccgaagggatgtaaacgtgactggatgagttacgttggcgaccccatgcgtcaaaattataactcgcgtatttcgtccctgcctcggtgatgatatccgtgatacttcccagataatcacgacctatataataaagtttccagctattcgtatgatccttcaccaataccgccgaagcgtcgtagtaattctctcccgccaaatacagcttctccttattacccgagggagtctcatcgatctcatagcaatcccccaaataatagcgggtcaacaaacggctaccccctttagccacctgcatcttcacacgctgctgattgccgttataggtaaacgaggccacgttaccatcttgcgtaatagcgttcggacgcttgaaagaggtatagctaataacctgtgtggcggaagacataataccatttgccacgctagaggaagatatggcgtaaggcttgccacttgtattatatgcgaatgtaccactgacatcccctttggttaagatatttcctttcgcatcataagttgccataagccctttgtaggaagtcagacgattaagattatcataagagaatttctcttcttgggatacattaatgtctttccggtaagtcaagttccgtttaacaggatcaaaaacatactccatattctggaggaatgtggtcacccctgttttctgtatcttcctggaagtagggaatccataactgtcatatccataggtacgagataaggcaccggagcgtacctcggtaggtaaccccatgtcattctctttcgtgagcttaaatatggatgtttggttattcagcttggtctcaactaaatgaccattcgcataattataattctcggttgtcaaaactccggattgagacgtatacttaatagagcttacatttcctccgttataggtataatcctttcgtaaatatttattgtctaccgccgtctctgtctggctcgacagacgacccaacgcatcatatacataatcaatggaagttccgacagaagaagagaccttcgtcaactcatcgtagccattataagtatatgtagtcgtaaactctggtaaagtcgccgttttaaggcgattatacgtatcatacgtgtaattgataaccttattatttgcgttcgtctctttcaataggttgccggatgcgtcataagcataagttgtcgtaccagagctaggatcgcccaagctagtccgacggccgaaaccatcataaccaaatgaagtagtcacgttacccggtgcgacgatagaagaaggttgtccatccggacgcagattataggtaatcgttcctactgggtctaccacagatataagattgcccaacgcatcatacgtccgcttgacagagattccatcctccaccgttgttatactattgccgctataaccatgagtcgtttttcttccggaaggttccgatatagcggttaagcgatcatacgtatcataactatagatattccaagccgtagccgaactaccggcaaacggacgagagactttttgcacccttccataactatcataaattttatccgtttttagaaaactgccattaaaacgagtctcggccgttcttacctctctattcaacgcatcatatacacttttagtagtaggtttacccgtcacagaacgggttatggcatacaaagcgtttgtcccttcctccgaccatccgtaagatacagtagcggtagtattatcagggaacgtgacacttgtctcccgaccaaatggatcatacgtatgcgccgtagactttccccggtggtccttctcagaagacatacgcccctccgtattataagaaaactcatttgcaagtcctaatgggtttgtcacctttttcaatcgaccgttcgtatcataagcatattcggtcttcagccctttatccgaaccatacaagaatagcgtctcttttgtgatattacccggagtatcataaacatactcgtaagttttcgctttatttccattcttatagaacaccttgctattcgcatagccgttcgtatgcgaaggaatattcattcgctcggtataagtactgctattacgagtagtagtcacgctctgatcggtcaagaaaccaataagatatccactctctgccgtattgttataaaatgtgttcgccttttttaccgtaatacccccagtgtaagtgatagtctcttgcgtcgcatttccataagtatcatatacaaaagcggtagtagccgtaatacccttaagcaagtcctgctctgtcttattgcttaaacgtatcttgaccgttttattggcttgaacattaacggcaaaattataggtcaatttcgcctcaggtgaaacctcactcttcaatacgccatatttataaggatcaaaatattgctccgtaagctgccctttcaaattcgtacggaatatactctcaaatcccctaaaccccaatccttggcggtgaataacaccacctcggtacgtgaaagtgaaattatcaacccggttacctttcatataagtactggaaaaggctatgacaggaatagactcttgaatgtccacatacgggaaaacagcgttcacacccttagcataagtaccggaagatatggcctcctcattcatcaacaggtatgtgttcttttcgaccactcccaaactattcgccatacccgtggccaaaacgcctttattgtcattcctcttgaatgaatattttgtaaccactccattcttcaagctgaccaattgactaaaataattatgactgtttatattagtcgggatcaagattgatttcgatgtataatcttgggcacattcaaccgaacccacgttatttttcttagcgaggtaagtgaagaaaccggagctatgataccggatcaagtctgtcataccatccccgtttacatcttgtagcaaaaagccatccgtagaaatccccgagttttgagtaccggcaaacgtggatttataaaattgtccatctcccatcgagttataagcggcccacgtatagactggatccttttttttcggagataccagcaaatccataagcccatctccgttgatctcccccagcaacaacgagcgatcttttagatccaccttttttaatccggtataagtagagacttttcggcccgtccaagtactaccggaaacatcaaaagtatatatatttaccccggagtcattaataagagcgatgtcacttttcccgtctccatcataatctaataccagaagtctatctgttttctgaaatgcgtcctcaggatcaggctgctccgtgcctacaaaattaacgttatagggaaacaagtaactctgatataagaccttaccactttccaaatcaaatatatagcatttagaggtcttactggtctctccaaaaggatgatggcaagagaccgctagtacttcctgttttccatccccattgaaatcccctgtataataaaacttaggatgtatgctctttgccccatccgcatcggtcaatacggtcgggaaattaaaagtccgtgtatatttagataccaatcccacagtcaaactggccctatatacacggaaagtcacttgatcattatcaccggaaacgccattgtttacttttatgatatgctcttcttgctttccctccaaatccgcacaaaagatatcgataaaattagctccggtcgtaagattgggcatgggggaagcgtactcgctattcaatccggcataaagatagattttctcttctccggtgaatttattgtcatatctattctgggaatgctgaaaagccgtcgaatgtctgtaatgctcccaatagggattctcattaggcaaagagatcaaaccatctgcccccgacgcataatcataccttcctttcactaccttgatacgagcaggatccgttgattcataccaattatatagctgtgtgacagaaccattatcataagacccatctgttatgccttctccatagtaaagctttatagggttcagagattgcccggaggcggaataatctatctggcttaaaactgagctattgttctggtttttatagctcaagctatacgtacaaagcgcagtagagcctaatttactgatgattttagccagcaagtagctttcccctgtcttaagcccccctataaaagagaccaaggggtccggtcgtgaggcttgatactgaaattccacagaggcaccattataagcaacttttgtcaatctgtaatggttttcttgctcgacataagtatataggatctgattatttcgcaagtcagacaaagaaactatcggataaaagatcttattgcttgtatttgaggcatatccaaatatgcccttggttccattaggataaaatacctcaaaatatttcacgacatcgccggacaaaaaagcttttacttttatattgccttgctcggactcataattaatagttgtcgcattctctgagatctttataagacgcatcccgtctaacacgaacgcatccgctttcgtacgtaaagctccttggggcttaccatcataataaatattcctactcgtacgcatgatcgattgcacaccgccaataccccatccaataccaacgatgccatttccttgctggctattataagccaatgataattggggttcaaatccatttatacccggataaacctgtatgggaaccgtataggttttagctccagtcggggaaacacctgtttgtatcggtatctctcctacagctttcgatttatctattgtaactgtagtcggaacgtaagtattatcagatatggctttaggaacaaaagcctgaggttgctgtgaaaacctttccggattttctgcagttttcgctataaccggaggatataaagccttcaataaagaatcctcataagccttgtaatcactttccttccaatcgaaaaattgattattctcagcaactccttgggcacataaataagaagatggggacataaacatgataaatatccctatcgtatataaatatattaatttcatctataagtatacttaaattatattttgatcaatcctcctcttggtctacgggaacggcctccaaagatgaagccatcgcactaaattgccgtgttgttctatttcctgacgcatcataagtataagtaaatatcatttgttgggattgcctaatattcaaaattccgccagactttacctcaaaaggcccattaatcgtaatttgcgccggagcggaaagagataaattaccattacttgccacggttacattttggacagccaacgtattacagcccaaaactgatacacttgatgaaactgtctgatttgtataagtactcacacagcttctcgtgtcaacctcttgtgatgataacggggaaaataagcaagtcaatacgatacatgtaaaaaagacgattctctctttcatatcaaagaatttatgattctgttatttctatttttaattccttgagattacagacttacatacttcttcaaagtatccgctttcttcccatccacaaacaacgtataaataaacgttccataaccaagttccgaacggcttacttctaccacattactacttccattatccaacttaataactttcacgggtttacctgtgacatcaaatatctgtagactagcagacacaaacgtcgccggtaaggtataagagacagaagcaccttccctattatataattttgcgctatccacagcacttatattacttgtggaagtcgtgctcgaacgtaattgagattgtacctccggcgatagtagagcttgcaaattatcaatcacctcattctgttgttggatcgtttgttgcatctccttgatactttctacgataagcggaataaaacctatataatctatagacatcatcccgttttcatccgtttgtacaagttcgggtaataccttttgtatgtcttgagccaaaaaaccaattcgtttacgactagcctccgctgcctctcttcgatctatctctgcttggatttgtttgtctctatttatctttgcgatagtagcggcatccataatctcctctgaatcggaggaacttcccgatatcccattatccaatgtggcagagaacttagactcatcctgctccctattctcctcaagtgtagagaggttgtatgaataagagaccccattcacttgctctaaaagagctaatggattttgcagcgactctacattttccttcaagcgagcgtctgaagttatattcactccattcacacgaagattcgtattgaacacgaaattagtattactagccggattgtaatacgccacgacattgttagcataaccatttgtagtcatataaatacccaatttcccatgcaaccaaagttgatccgtatccgtggttccatattctccagcaaacacattccaaccttgatttgcatattgtccaaaatcaccaaatgttaatttcgaacctgcgcgtgcatcccctatccgaccatatatctgcatagaggttacatttcctaagtcctcattattgtcttttaaaaggcctgcttgtactcgtccatttgaaagaacccggagttgagcatttgcgtttgatactaaactaattaaaattaagaaagaaaaaagtcttgttgttttcatataagttgttctaaaatataaatagataaacattcaaataatacttctaaggaacccagtaccatatccaaacaattgcgtaaaagaggctattacggatagcgatcctacacgtaaatcacatttattgcggaacattgcgtctacaaacaataaaagggcataaataataagaggcaccagaaacaagcggcaaaagaatgagccgataaccaatagacagactgaaaacgtgaataatgccggtaagcaatgtaccagcttcaatgagccgggatgtttccggttcaacgcgatccgggcctcccccgaatgacgtacctgacggaagaactgcgtgagatccgtccgccttttatgataaacccatgctgaaggaaatagccgggtccgataaccagcctccatgatccgtatgctaaaatcaatgtcctcaccatatcgcatgccggaaaaaccgcccagacgctcatatacatcccgccttattcccatattaaaactacggggataaaatttatccaactttttcttcccgccgcggataccaccggtcgtcaggaatgaggtcatggcgtaattgatcgccttctggatcggggaaaacgaggcatgcgccttatccgggccaccgaacgcatccaccggataatgattcaacgattcgtgtatatgctcaagccacgtggagggtagtaccacgtcagaatccagtatgagcagatactcgccacgcgcttgcctagcgccatgattacgcgccatacccgggccggagttcgagatcacataataatgaagatccaaccgcccttggtatcgcccaacaatctctttcgccggtatctccgaaccatcctccaccacgataacctcaaaatggacataggtttgcttgcaaaggcttgataacagatcatcaagctcatccggcctgttataaacaggaattataatggagtataatcgcatatcttttgtataaaaaagattgaggataccctcaacagacagtatcactcaatcttatcaaaaaaactatagcttcaatagaaataaatattattgtaccaatagcatacgtttcgttgagatcaactgtccgtctactaccaaagaatacatatacatacctgcgacacctagatcagaaaagcttaccattatactaccttctccccgggtagcgatatcgaatttcttaacttgagttccttgcaaattgcaaatagagataaaagcagaacgtgcggatgtagggatcgtaaaggatatattcgtggtagaattaaacggattcggcgtattttgattcattaccgcattcgagagcaaagacttactcgtcaaattcttgttattctgcaaatcagacaaattagctttttcatccaattgcaattccagttgttggatagtagcgtccaattcttttacagcctgtactaaaacgggtataacagccgtgtaatccaccaagctatcacctgtggaacttaacgtcacaatctctggcataacctcagctacctcctgtgccaagaaaccaaaagctttagaaggtacggcttctgctgatctcaattgcgatgtctcacttttccaattgtaagataccggttttaaccccaatatggttcctaatccactatttaagggagtgatattggttttcaaccgagcatccgaagattgataaaccccctttacttctatataattatactgggagctttctgaatcatagaaaacgacctttcctcctgttcctgagatacgaggattagcgaccgcaacttttaatttcaagaatgtacccggataatcactcccgttataatacaatttttgtccccacgtttgtatgttcgtgtactgggcttggacactaaacgatacgaataggcatagtatgcctaataaagatacagatcttttcatgatttaaagatttaagttgataatatctattttaacacatcaaaatatccaatcaaataattatttccttttgatataaatatcttataatcaccattcagcaaaaaatctatagaaataggatattctatctcagaagaaacagttatgatgtcattataaagtacatttccttttatatttataattttcacattaagtccatccaataatttattagaatggatgtaaatattattttcatctattgataatgtaggagaagatattatagaacgatcttcctcttcttcccaagattgttcagtatccttcactctattcggatacacaactgaagaaacaaacatcagaaatactaatcccaatataaaacttctctttttcattatctatttttataaacaaaaatagtctctatgagaaatctataagcaaaataggatttacttcttatttactttttgtttacagcgattaagttattataaatcagcgataaatttatccatcatttctgcggtaccttctgttccatgaatctttttatagagacgaatccgggatgctgttattgcaggagttgagcgtccaactaaccttgcaatgtccttcacaggcatggatatttttatcaaataacaaatatggagttctaactctgagatttgcgggtataaagcatataattgagcggtgaaatttgaataggttgtatcaatctcttttctcaactccttccaatccttattctgaatttccgtatcagtattattacttgtttcatgaaataaccgatagacttcggattttcgaaaagctatttcaagcaaacttttttcattttgagaagtaagaatctttcggtttgatagttctaataattccttttgagattgcacaagttgctttttaaaattatctctttgacactccgattgctgcaaaagttcctctagatatgaaattttcttattattatattcaatacaatccaaactttccgcatattgattctctttcaatagacgtatttttttctccttttcaatcgctgcttttttcttcttttctaacacatatatataacatagactaaagaaaataattaaaacaacaaataatgcaaattgataattgcgaatttttcttttttcattatctattttcaattgaacattctccttttctgtatgctgatacttatataatgagttaacttttgctacagcttccgtttttgtttgattcttaattgaatcagacagttctatacatttatacgcataattcaaggctaatttacggtctccttcttggttttttattttagataagattctatacgtattttttttcatatagatattcccatactcatttgctttctcaaaataatatagagctgaatctatttgcttatagctttcatatatacaacctaatccaaaatatatatttgcttgattcttcatacttgaaaccttactgaacaaatctttagccaaatcatattttcccatatctatatagatgctactcaattcccttagtacattatctattctcgattgatcatttaataacaatgccttctcataagcagattgatagtagtatatagcactgtctgtatcttgcttggcgttatagatccgagcaatattcctcaatgcgatcacctctccttttcctttatcatacatcttgtattcatacgatttcctataagcttcgagagcctcatcatacaaaccttgatatgccagtcgatatcccatctgctcataaacccgtcctaatatatcatatcgcttactatctttccctatgtccgcagcatcttgaaaagctctcaccgctcttggggcatctcccatatcccggtatgtacttcctagataataatatgcctccattaattgatctggagtcccatagtcctcataatactgaactattgatttaatcaaagagtctgattcatgaggaatatacagcttatctttagctttaatcttaagcaaagcatggtacatacgtatattttccggctcattcatgattgagctatccaaagaggaaagacagagtaatgcgctatccggatgctcccacataacagattccgcacgagataattccgctggtaatggtttttcttggcgcatacaagaaaaaagggtagcgaaaagtagcaaagtcagtcctagtgttctcttcatttagattacagtttacaacttaaacgcaagttataaaatttattttataaataccactaaaatatttgtttttcaatagtgattttgagatacgatcagccagcagggagatgcggcacactacgtatccactagttgtattatgtatttaaaatattagcatataagcatttgcagttttttatggtaaaaaacaaaagtttatcaagcagaaaacttttgtttccatatatagaaactaaagtttcttcagcacgaaacttttgttttccctaatagaaactacttttacatatataggcactacgacacacgaacctaaacgataatttggtttcttgcgttttctatcaaaacatggtagataaagaatgataattgtagatattttctatctacaaccactatataagatgtttatttataaggcatataagaaggaattgtagatgtggtagatattaagtgttttttattaactggtaatttatggaactcgattatataatccaacaagttcttgtaactttgcagccattttaattgaaatcccgattgaatatgaagaacaaatacgaggctaggctaggtacggaacgtatgctaccgctggttttcaaaatggcgcttccggcggtagcggcccaatttgtcaacctactttacaatatcgtagatcgtatctatatcgggcatattcccgagatcgggacaaacgctttggccggtataggggtgaccacctccatcgtgatcttgatctcttctttctccgctatcgtgggagcgggcggttcgccgttagcggctatcgctctcgggcagggcgaccgggaacgggccggaaaaatagtgggaaatggatttatattgcttatcctatttactatattcacttccctcatcacctataccttcatggaaccgatcctgctttttacaggagcatcaaaatatacgttaggatatgcggtggattatctctctatttatttactgggcactctgtttgtcgagatatccacgggcttgaatgcctttatcaacgcgcaagggcgtccgtctatcgctatgtgctcggttttgatcggggctttattgaatatcgtattagaccctatcttcattttctggttggatatgggggtaaaaggcgccgcgctcgccacgatcctatcgcaagcttgcagtgccatatgggtattgagcttccttttctcaagacgtgcctccttgcctttggaaaggcggtatatgagactggaccgaagaatcgtactctcgatgttcgctttgggaatttctccgttcatcatggccagtacggagagtctggtgggtttcgtcttgaatagtagtttgaaaaattttggcgatatctatgtgagcgcattggctatcttacagagtgccatgcaattcgctagcgtaccgctgaccggtttcgcccaaggattcgtaccgatcataagctataattacggacatggagacaaacagcgggtaaaagattgttttcgtatcgtgctaatcgttatgttctctttcaacttgatactcatgctattcatgatcttattcccctcaaccgtagcctccgcttttacaagcgacgaggagttgatcgataccgtccgttgggtcatgcccatcttcttggcgggtatgacgatttttggcttacaacgagcttgccagaatatgttcgtagcgttgggacaagctaagatatctatctttatcgccttgcttcgtaaagtaatcctcttgattcctttggcattactattacctcattttatgggggtaaccggcgtatacgcggcagaagccgtatcggatgccacggccgctatttgctgtacgttgttatttatatggaaattcccgaagatactagggaaaatcaagaaaaaagaagaaagggctgcccaataacggacagccccctgataaagccttaaagattaaaatgaatcgtattaatatcccggattctgtgtcaagttaggattcaggctaaggatatcggcatagatggagaataccgttgtatatcccgtcttatcctcttgataatccagcgagctggcggaatgtttcacgcctacatagcggtctaccgtagcctcggtaaacttgccgaaacggatcaaatcctgccggcgtacgccttcccaagctaattcaagcatacgctcgtctaatagcgtatccagcgttacgttttgtagcggtttggcgcctacacggttacgaacttggttcacctcatcgtctccattctgtcccagacgaatcttggcttccgccttcatcagcaacgcgtcggcgaaacggaagatcacgcagtcatttccatgcaagtttccaccatcctgagcattctggtcgaactcatatttagccatacgagctccggcggtcttcaccaacaaaccatcggaggcatccatatataccttcggggcgttcggctcatatttcaaaggaactttctgtccgtcccattccgtatagatcgtctttccgtccggaccggttacctcgcccgtaaaataagtaagcttacaacgaggatcctcatccgccgtaccgaacttaaacacgttcatcgccttcaccgtagcgcaagagccattccatccggattggccgtaagcggttgcatgatcataatggcgggtacgtaccaaattgtagtcctttgcgtccggataagcgaccgggtccataggaaccgtgaaaatattctcaaccgaggtctcgttcgctacggcgaaattctccgagaagtttccctgcaatttatagcccaaagcctccagcttatccacataggcgatcgtagcttcccaagcgttcatctctttaccgccaacggtaaacttgatgttctttccatccggacgattgccgtccgtccaattgtcgtccgcataaacctccgcgttcaacgccaacttagccaagatcatataagccaccggcttggtaatacgcccgtaatactcgcccttttggttactgcggttatctgaaagataaggcaacgcctcctccaactccgaacggacaaagttaaatacaacgctacgctcagattgctttacctcagacatcggtgtcgtagaggaagttaccaacggaacacgagcgaacaaatccaacaactcataatagaaaaacgcacggaccgcacggacctcttccagataaaccttgaaatattccacgtccggttgttcctcggcaaaggcttgcaacttatcaacactctggttgcattttccaatctgctcatacaagaaatcccaagagttcttggtcaaatcattcatcgtgccccaacggtgtaagaaaatattctgccataaaccgccatcttcccagtcgccaatacggcaaggaagcatagcctcatcgctggagaaagtattcaagtcatatacatgacggtcgttacccatgatcttgaacatattattgtacaggctcgcaaccgtgtttacatagaccaacgtagggctttggaacgcggtctcctcatcaaacgcatccgtaggacgctcttccaaaaaattagaacaggaagaaaatgccgcggcggcagcggctatcataaagctatatataaatttctttttcatgactctttaaatggatttagaagttaacactcaaacctaatgaatacgtacgggataacggatagaaacgtttgttatccatacctaggtcattattatctttatcgaccgtcgtactgttaatcatcggagacaaaccggagtaacccgtgatcgtagctacgttgttcaccgagaatgtcacacggatattcttcacgtatttctcgatcttcttgcaatcgatgttgtaacccaacgtaatataatcgatattcaaataattacccttctccaaccaataatcggagatcgactggtcgtagatcttgctttccggagcctcagccaacgcgttgtatgtagggaactgactcaggttcatataagctagcgatgtaccattgaagatcttatgaccgaaagcgccgttcatctgcgtcatcaagtcgaagcgtttgtagcggaagctgaagttcattcccagataatatttcggcatggcttgtccggcgatataacggtcgccaccatcattggtatccaaaccctcttttccatcgatcgtctgatccaagttatagacataacggccttcgatagcgtttccattctcatccaaagccggagtcaagcccaagcaacgaggaatgtagaacactccgacaggctggcctaccatctgataaaccacacggttgtttcctacgaaaccggcaccactcatactggacagatccatatattgtttcgcctgcaactcttgtcccatataagaaccgctcaaggagttcaatttattcttctggtaagagaaattcacgcccatgttgaaatcgaagtcctttgtcttcacgataccaccgcttacagccaattccacgccggagttggtcatctctcccaagttcgccaataattccggatatacgaacggaggaaccggaaccgcgtatttatacaacagatccgtagtcttggaagtataccaatcggcggtcaacgtaaagcggccatcgaggataccagcgtccacacccacatcgaatgtctttttcacctcccaacgcaagtccgggttcgagttacgtgtaaagccataggtagcggtagaatttccattgacggaagtcacaccgttcgggctcatcaaagccaacgagttataagcctcgatagcatcttggttaccagtcagaccataacccgcacgtagtttcaactggctcagccaatccacgtctttcaagaaagcctcctcattcaacacccaagcggcggaagcggaagggaagaagccccatttattattcatacccaatttagaggaaccgtccgcacgtaagttcacggtggcgataaaacggttgtcatacatataattgaaacgacccatgaatgaggccagacgattctcgttttggaaagaagtcacgtctccgtatttcactgtaccacccgctttcaggttgttataaccgaagtaatccgtctcaaagccacgggcaccggcgctaaatcccgtataatgatatttttgtcccctctcccagacaataaatggattcaatcgttacgctgctatttctcggtaaataatgtatttacacttaccggatataccggaggcgatcccgctaatatcaacgtgaatggcgtagaacccggtatcgagaccacttccatctatcctgtagcccgtaccttcacgctgggattatccgtccaattctaaagacctccactgcaagccgggttgcagtaacacaacccgcaaggctctatccggaaaacctgtagtctatatttattttgtacgaaaagcaagcgcaaaaggaacaacctaatcagttaatccctaactttgtgagcctaaacagtagaaaacatggtacaaagattcgattacttagtgataggctcaggaatcgccggtatgagtttcgctctgaaagtagccaatgaaggcaagagcgtagcacttatctgtaaagccggacaagaagaagccaacacatatttcgcgcaaggaggtatcgcttccgtaaccaacttgaaagtagataatttcgagaagcacatagaagacacgatgatcgccggcgactggatcagtgaccgggcagccgtggagaaagtcgtgcgcgaggcccctgcccagatcgaggcgcttatccgatggggagttaatttcgataagaaagaaagcggagaattcgatctgcataaagaaggaggacactccgagtttcgtatcctgcaccatgccgacaatacaggagccgagatacagacgagcttgatagaaacggtaaacaaccatcccaacatcgccgtattcacgaaccattatgcggtagagattatcacccagcaccatatggacattatcgtcacccgccatacccccggtatcaaatgtttcggtgcctatgtattgaacgaggatacgggcgaggtacatactttcttgtcaaagataaccgttatggcgacaggcggttgcgaggccgtttaccggaatacgacaaacccgctggtagctaccggagacggtatcgccatggtttaccgtgcgaaaggctccgtaaaagatatggagttcatccagttccacccgaccgccttgtatcatccgggcgaccgtccctctttcctcatcaccgaggcgatgcgcggatatggagctgtattgagaaaccttggcggagaggagttcatgcataaatatgatccccgtctttccttggctccccgtgatatcgtagcccgtgcgatcgatagcgagatgaaacaacggggtgaagaccatgtctatttggacgtgacgcacaaagatccggaagagacgaagaaacatttccccaatatctataaaaaatgcctcagcttagggatcgatatcacgaaagattacatcccggtagcccctgccgcccattatttatgcggaggtatcaaggtagacttaaacgggcaatccagcatccgccggctatacgcaatcggagaatgttcttgtaccggcttgcacggtggtaaccgattggcctcaaactcattgatcgaggcagttgtatatgccgatgccgcggcgaaacactcattaagcgtcatggatcgctatgagttcaaccaggatgtaccggaatggaacgatgagggaacgatcaccaatgaagagcgtgtattgatcacccaaagcatgaaagaggtaaaccagatcatggaagcgtatgtaggtatcgttcgtagtaacacacgtttgatccgtgcgtggaaccgtttggatattttatatgaggagacagagagccttttcaaacgttgtaaggcatcccgtgaattatgtgagttgcgtaatatgatcaatgtaggttatttgatcactcgtcaagcgatggaacggaaagagagccggggattacattatacgattgattacccaccgattaaataattgaaaattgagaattgagaattactagctatgttaattctcaattctcaacttttaattatcaatagttctgtttcatcggttcaaagtaagcttgcggatgagcgcatgccggacaattaaccggagccttcttaccctcgaatacgaaaccacagttacggcattgccagaagatagcctcatctttctcgaatactttaccttcctctacgttagccaacaatttacgataacgtttctcgtgttcagcctctacctttgcgatcatcttgaaagctacggcaatagcgggaaaaccttcttcctccgcaatcttagcgaactcaggatacaattcagcccactcctcattctcaccagctgctgcggctgccaagttctcagcggttgttccgattacgcctgcaggataagaagcggtaatctcaaccattccaccttccaagaatttaaagaaacgtttagcgtgttccttctcttgctcggctgtttccatgaaaacacctgcgatttgctcgtaaccttctttcttggctacgctagcgaaaaatgtgtaacgacttcttgcctgagattctccggcgaatgatttcaataaattctgctcggtacgtgtacctttaatacttttttccataatgctaattttatgtagtaaattaatgagtctgttttgtatatcgtttttctcatgaccgatcaaaagtaagaatttgtttccagatatcgattacgcaaacattaaataatatctatctctcaatagatatcacttatttatcaaggaaaaacttctcctcctttatacaatgaaacaacaaatcctcctaaattgtttacacaaaaccggaatgcgtctttagattttttgcatcttctttattttattaactttgcatcctcaaatcaaacaggcaagaagaaaaatgaagaacaaatttgattttcagcccaaactctttacggcgctgagaaattattccaaagagagattcatgacggatctcatggcgggtataattgtcggcatagttgccctaccactcgccatcgcttttggtatcgcctccggggtaagtccggagaaaggattgatcacggctattatcggtggattcattgtctcccttttaggaggctgcaacgtacagatcggcggacctaccggagcgtttatcgtgatcgtttatggcattatacagaacttcggtatcgaagggcttgccatcgctaccgtcatagcgggtattattctggtattgatgggcgtgctgaagctcggtaccgtgattaagtttatcccctacccgattgtcgtaggtttcacgagtggtatcgctatcactatcttcacgacacaaatgaaagacttatttggattgactatggataaagtccccgccgatttcatctctaaatggatcgcatatttcggggcgttcgatacggttaacccttgggcattcgttatcggtatcattagtatcctgatcattacgttaagcccgaggctaacgaagaaaattccgggttccttgatcgctatcgtcatcatgacgatcgttgtttacattatgcgtaatcatttgggtattacaggtatcgagacgattggagatcggtttactattaacgcttccttgccagccccggctccgatcacgtttaatatggagacaatcaacttattgcttccctccgcctttacgatcgctatccttggggctatcgagtctttattatccgctacggtagcggatggtgtgacaggcgacaagcataattcaaatacggaactaatcgcccaaggtgcggcgaatatcatcgttcctatttttggcggtattcccgtgaccggcgccatcgcccgtacaatgactaatataaataatggtggacgaactccggttgccggtattattcacgccatcgtattattattgattttgcttttcctcggaccgcttaccaaacacattccaatggcttgtctggctggcgtattgatcatcgtatcctataatatgagtgagtggcgtacgttccgttccttgatgaaaaacccgaaaagcgacgtatccgtcttgttggtgactttcttcctgacggttatctttgatcttacgatcgctatcgagatcggccttctgatcgccatgttattttttatgcgccgtgtggctgagaccacgcatgtatccgtcaccacggatgagatcgatctttccgacgagggcgagattcatcatgacgaggaagtcctctccctgcctaaaggtgtagaggtatacgagatcgatggtccgttctttttcggcgtagcgaataagttcgacggcatcatgaaaagtatgggagataaaccgaaagtccgcatcatccgtatgcgtaaggtttcgttcatagattctaccggtctgcataacttggaaagtcttttccgtctttccgaggcagagcatatccatatgatactttccggggtcaatgaacatgtacaccgtgtattgacaaaatccggattcgataagaagattggcgcagaaaatatttgcagtaatatcaatgaggcggtagagaaagcgaaagctgccgtacaagactaagatactatcagacagtgggagacgcagcatgctgcgtctctacaactggatatttattccggtaaataataccagtcctctggtaagacagcttcctttattttacggctggaaaccccgacctccaaggcctcgcccatataatcctcgaaatacaaaacacgtaattcgtggaaaccagcgtctaacgctacctttcctttcgctatacgagcattatgagagccatcattatcaacaatagctttaccgtctataaatagcttggaaccatcatccgaatacgtataaaagcgatatacacctttttcagggatatttatcaacgtacggaactcataagcgaaatgatccttggccggagcctcctgaatggagatatttttcatcgtaccctctttcacttttgtcccggaagcgatctgatccgtatgtttaaacttgccttcataataggtataagctaccccgtgctttttaggttttaccgttttggcgggtaagaattccatcgtttcctcatccttagaggtcaggccagacggataataatacgtatattcctttccggacgaggtacgaatccatgaatcaaactcaaacttgccctcacgcaattcaatgatacggccaccccgctcgaaatctccataagcgtcccatccggatacacgcccgaaagctagtcccacgttatataacattcctatataatcattatcatgatcgtgcccggcaaaagtagccatcacatccttcatttccaccaaggaagcgaagaagcccgtgttgatcttgggagaggcgattccctcttctttctgtcctaatgtagtctccgccccaacgatctcattatattccagcaaaggaatatgaaaaaaggccaaggctggcaacggtttgccaccattttccttggtatagcgcatactttgctcacgataccaattgatctggtcgaaatgaatccaatcatacgtaccgtaatcttttagcgtaggataatcgttggagtcgatacaatacaataaggccgccggtttctttccgtctgaactgtagaccggtaccacatagtttccggctccatgaatatcacccggtcccttctcacccataaaataaggtgattgactgagtagggcataaatctcgtccttgggaacgatctctgcgtcatgatttcccatcatcaccgtaaacggtatcttggcctcctcaaagatcccgatcactgacttccatccttccaaaccgggatttgctgtcaccacgtcgcccgtcagcatcgccacatccggattttccgcctttaatacggattgtatcgtagcgactgtcttagcgcatttagatgatttctgatcccaatgaatgtctgtaaattggacgatcttgaatttcccatccttgaaagcaagctgtttttgtgcgaataagctcatcggggcacaaaagcacaacaaggctatcgctaataaaaaagtctttttcatgttcttcgatttagtaattgggggctaagttataaaaaaaagagagcgatgtataaaaacaggctctcttccttatgttaaatgccacaatgaaacccttgctgtcaaacaaaagctatatacatatccgcaagccgggttttcctgtcaaaatgcgggatatcttttactattttctcacaatcctcaaggctcattcctcctttaggttccccccagtaccaaagtttaggggtattctgttttttacttgttgactccataattctcgttgtttttatcgtaagacaggaaacgctcaaatacccctatcctcaaaatatataaaagattaaaataatgtgaatttatatccaaccgacaaccccaatttcaaatcccggtcattgacacaattctggaaatagttcactcccacataaaatctttttacctctataccggccgccgccgtagctcccagattccaatattcaccactaccggtgtaagcacccgcatttaatcggagattcactttatcgctcaacggaatatgaaaagaagcatacacgggtacaaaaaaatcaatattccaatcatctccatatgaaaacgaattccctgcggtatgcagcaacaatcccgtttgtatagaaaacaaccgtgattgtggaaagtttatatacgcccccgtctgaagcccccatccatctcctcctagtattccggtacgagcttctatatcagcggcctgcgatcgaccaaaagataaaagcaatattaacagaacaaacaacttcttcattacttacaaggtattaatttaatatttagattgaataaaagttcgacatatcatgatatagaactcccattcaatctaaatattgcttctatatcattattcggctccaagttagtgtattccgaatatagcatcttttatgacgatcgaatcttccgaattctctatattatataggatgccttccatcttcccttcaatataaggggtaccacttccctcatgaaaacgaatactatccacttgtatccgaaatgaagatttcagtggatgatacactattttagcgtcatctttcgtgatcctaacagtagattctatctcttcattcaataatttacccttatcgatcagatattctccttctctcaatggaatcaatgagatcctcagcataggataaggatagtcagagatatgcactcctaatggtatctcccaatagaaaccgcttaaatcggtatttacctcctgccaaaaatttccatgatcaataaaagaatgagagttcgactgattagctatagaaatatcttgactattcacctttccttcaaagtaccccaaatagtaaggagtttcttcaaaagaaatatcttcacctttattacaagatatagacaaaaataataacatactaaataaaaaatagattacctgtttcatattacaataattttatataaatataattcttatttatcaattacatactttaacagaatcagttcgtacattctatcttaaatatagatattatttttaagattatctctacatattacagtcaaaaaaatatcaaaccacaaaaattaattatattttaatggacttagtgctaattgataccatccagtcctatatttatctgtatagtcaggtttccaatcccttccagttgataaattcttctttgattttaggattttatcttcaaaattaacaataacttgacctaattcatcactagctaaacttttagtaactgtatatgaaactgtttttgatgtagttgctgtagctccaaattttaaaccaatctttactttttctccaaaagatggatcaaatccaaaattagttgcaaatgtagctgttgaagattctacactttgaatagtttcactaatatctagttcttctatcgctatttttattattgcaccataattctctatattccattcgaataatggaaggtccaaagctattccatctgttaactctattgatttaacttcgaatttactactaagcggatcttttggtgttattttaaacaatgcagatggtttaactataaaattgttaatatattcattacctataccagcttgatttgcaacatacacttttactataaattcaagtgatccgtctgtccatggtgtaagaatagtactacctccgggacgaccacctcctgtttcttgatgagtatttccatcaattctaggatcttcactttgatcacaaattttgttcataactgtacgtggatctcctaataatttaaaatacaccaaactttccttaaaatctcgattgaaaggtccttttggctgttgaggagtcaagccataatatatataatctctcggccattcatttgttgcagcaaatacgtcgtaggcttcataaacctttttcatattttcaggtattgatcctgtgcgatctctagtatcaccactagaaaaatttctattctgtatgactgaagaagcattctctgtattatcaaatacatcactaaagaatacaatatcaggatttataatactcatcggtgacaaattcctttgagccttatttacagaaaccactctttcatttaacttcactactacaataggatatttaggaatttcatttgatggtattaagaattctttatttactccatagcccattacatcattactatttttaactcttaaagctgtatatggaacttcactctccacattccaaagttcagcagaaaaactgttatcaggcaattctggtacaaatatagttaaggttgaaaataattgttttattttttctaatctagttatatccatatacaagctcattaattcatcaaccgtttttccagaagttaatctataagaattaatagataaatataatacatcataatcataatcaaacatctttaaagcttcatttttaataatacgccttaattctattgaagaatctaaactataagctaatgccttactaaattcttctaataattcatgatttgttattgtatcattactaacagtggtaatattacggcttacttcatttcttggtaaactataatctatttcctctacacaagacattaataataatactgataaggaaaacattattttaattatttttttcataataactattatttataattaatattttaattaataaaatctatagaaataagaatccatatacattgttataaccatctgttatttgcaacacacctttttcttgatcttttaaaggtattactaaagatggcatagtactcgtttgtaccatttcattatagatcacttctcccgtagaactagtaacgataacacgcacattacctacattttcatagaagttcactatcagttctccactagcttcttcaatagaagcgtccataggcaaatctacgagaatagatttttttgaatgcttccagttaccatctaagtgaacccgcctaccaaaacagggaatagcacttaacaaagccattactacaaataaaaatttaaataatttcatttctcatctcattttttgatttggatgcgaagaacaggctaatagctcgaataacaaagaaaaagggctaataagtgacggacaaactcaatttataatttactgataattaataaattataaattcatggataggacaaacatttcatggatatatacatatatctatctaataaacaaaaagttacatcatattaataatataggtatacaaatctagctcctcccctataattcctagcttctgacgtacacgttggcgacgcttatttacagaatccggctgaatgtttaatagaatagcctcactgatcgtatctaaatgaaataaaactaaataacaatagcgtaaatccgcaagagtcatattgaactcagagaatttcttttctaaagatgggtagacctcatttgcttgagtaataatatttcgccaatatttttctgaaagaggggattttgtcgtaccaggaattactttttgggatagtttaatcactttccttgctatcatagatgataaaaacagattattacgctgttctgcgattctctggataatggatttttcttcttgtttcgttcgttcatatcgctcctctaacttcgctctagaataagatatattgagcaattcatctttttttgataacttatcgaataaatcctgaagctcacgttgttttatattcaagctattctgcagtttcaataattcaatattcttttgctcaatatcgatttgctggacatatattctcttatttttcttattcatttgcaactgataaacgaataacaataatagacaaacagtaatagaagtaacaagaagtataaaagtccattgtttatccatctttaattgggtattttctaacgatatttttaaatgattatacgctttttctgtctttacgatattcgctttattttgtaatgctaagatagaatctgcggcttcattatattgctctaaataggttaaagcattttctatattaccttctgctttttccagttcataataattataaattatggagatatgcgtattttcatttagggttggtatgatgttcgcttgctctaaacataggcgagcattcttgaaatctccttcttctatatagacaccggctaaagcggaatagtctggagcattatccaattcagaaacatttattgatttccataagtattgcttagcgagttctatattgcctaacacactataaacatttcctatcccattggatatatatcctatatcagaagaatcccctagttccgctataatagtatcagcttctagcaaatatctcaacccgacctctgacgaatccgcaaaaacatacatacgtcccacatctcgcaaagcgaaagctgcgctccgcatatttccgacctttcgaaagtactgttccgcttttttatatttatcttttcctaataaataatcaccgtcaaaatgatacaagtctcccatatagctacaaatatacccggcttgattatagtcttgacaacgtaaagcgatatccaacgcctgtaaataagccttcatagccagctcgttatccttatcctccacatacgaacgccccaagtacaaaccgatcctcgcttgctcctgccccgttccgtgcgactcgtaataggcttgcgcacgccgcaattgctgtacgtagggcagatccgtatataacgtgtccgccactttaccggatagcatacaccaacgagccaataatttatcgctcaaattatcgggcacggctatgctatccaataggataagggaactatccggatcagatttcaacaaggattccgcacgatcgattaggtatgtagcctcgctctcatctttacaacctataaaagagagcgtggataatagtaatatcagaataagcaaatgcctcatcggttcctatctttagattctatgcgcaagataggcatattttttatcaaaccttaaagaataattgattattaggcttattgtataaaattattatcgcttggatatctccatcatcttttggaaaaacacgtacgtgttttcataaattctcgtacgtgtttccgaaaaaagatgtacgtgtttttcctaaaacatgtacatctttttatacatctgattttcaatatactaaaaacagtattcccaaaggcagggatattgtaggaaattccattatctttggactttcattggtaactttttaatctactatcaatatggcacaacaatccggaagattgctatccctcgacgtgatgaggggaattacgatcgcagggatgattttggtaaacaaccccgggtcatggaagtatgtatatacgcctttagagcatgcacgttggaacggcctcactcccaccgatttggtatttccgttctttatgttcatcatgggggtctccatgtttttctcacttcggaaatataacttcaagctgtccaaagagagcgtgacgaaagtattgagacgcacggtattgatattcctcgtgggattagggctgaatctgttcgggcatgtttgctacaatggatttaccgatttccagaatttacgtatccttggggtgatgcaaaggttggcgctggcatatggcttcggctcgttgataggattagcgattaatcataagtatattttgcaggtagccgctggtatattgatattttactgggcattactaggtttcacgcatagtatggaaatgtcggaggatagcattatagcgatcgtggacagaactttattcggtacatcgcatatgtatcacgatgatatggcagatggtacacggatcgcctttgatccggaagggctcttgagctgcattggtagcatagcgcatgtattacttggtttctacgtaggaaaggtaatacaggattgtaaaaagaacaatgagttgattatccgtaatatcttcattttcggtacgattattctttttgccggtttcttattgagttacggctgcccgatcaataagaaaatatggagtagtacgttcgtattggtaacttgcggattcgcctcgttattcctcgccttattaatctggatcatcgacataaacgggaagaagaaatggacgttattctttgagtcgttcggtatcaaccccttatatctgtatgtacaaggggatatattcgccgtattgctgggaatgagcggtatctccgcctttatgtatatggatctgttcaggccgatattcggcgatttcggaggctcattagcatgggctatcttcttcgtggtactaaactggataccggggtatttcttgtataagaagaagatttatatcaagttgtaaaaagaaatgatctatgctctgtatatagaacaaaaaatcactatatttgctctatatacaaagcataaatacaaaaatcaaattaataatttaactatggaaaatgaacttcaagttattggaacgaaagaagtagaggaacgtattattgagttaagaggacaaaaaatactactagatagagatgtagcagaattatataaaacagaaacaagggatataaacaaagccgtgagaaataatcctgaaaagttccccagtggttattttttcacattgaaaccctctgagaaacagtatgtggtggaaaatttccaccggatggaaaacttaaaaaaatcaacagtagaacctaaagctttcactgaaaaaggactttatatgctggctactatattaaaaagtccaagagccacacaaacaactatcgctataatagattctttcgtaaaactacgtgagcttatccgaaatgtagatgcgattcaaaatgaacctgacctaataaaacaaaaaggtattgtgaaacgaactggccaactcttatctgatctgttgatagatgatgctgatacaactgaaatggaatctaccatagagttgaatcttatggccgtaaaacttaaacatacagtaaaacgtattaaaaataacaataaaaccgaagataaatctgaaatttagaattgcaaaaaaaatccaaccactctcctattcatatcggagaatggttggattttttataggtatcagcctagctgactagttcacgttataaccggagataaccaccttcggggtctcgcctctcgtatctacatctttccaatggatgttgatctctttcttctcgcccggaagcaaggagaaatagttgtcgctatagaacatcgggaggaattgctcgccatccttctcgcccactacattcacacggatcatcagagccggggtggatgaagtattctctaaggtagcggtagcggtccaagtaccgtcattacccttattggttgccacgttggatcgtaaagtaacctttggcatctcacgcaaagcttggtagttgccttcctctacgccacgcagatagaagttatccgatacgatcttgccattctctgtcaacgtcaacttgacgaaatgagcgctggatacgctagctgggaaatccagtttcatacatttgttggtagtatcttctttactatccacggaaacctcgttttcccatgaaatagaaccgtccatattgatgatttgagcctttgccgtcaaaccattacgtacgccggcgctatagttcactacctcgatctcgtccgtaaccggattccattgaatgtgcagaggctcggaggccttcttgcaaccaaagtaagcggcggtaggctcgaaataataatcgtaagtctgccataccatagaaggccatgccggatgcgtcatccacagcaataatcccttacggttcaagcttcttgattcgaacataccccggtaaccatcatagtttacccactgagccagatcggcgaattccttggcgttgttcggcttaccgaagcccttttcgatgatagcgttgaaagaagcgcaagactgggcgccttccatcgtataatcgtgttgtccccattgagcgttttgcggccaaagcgcttccggagagaaagtacgaaccaagctctcgtaattcatcacgttgggcataccccgctcactatggaacttatcactaccattcttcaagctaaagtattctttaacaggaagcgcacggtacgggccatggccacttaccacctcatccgccgagctggagatataatgtaagcccggatgatcctctttcacgatacggcgtaaagccttgtcgatctgctccggcgggaagccctcgttgcgcccgcaataaataccgatagaggcatggttacggaaacgtttcacataatcctcagcattggcgataaacatctccggatcataaggatcgggtccgtcggaaggattcgccaaccagaaatcttgccagatcatgataccatgacggtcgcaagcctcatacaattccttgtcgccgatttgtcctacccagttacgcatcatcgtaaagttcatatcagcatggtaagccacggcgatgtcgtactcacgaccccggtaattcaggttagactcaccgaatccccagttaccgccacggccgataaaacgacgcccgttgataaagagactcaagatgctattattctcgttgaaggtcatttgtcggatacctaccttgaaatcctcagagtcggataccttatcgcctaccttaaaggtgaaattagcgtcgtataaataaggagatccgtaccctttaggccaccacagacgtgggttctgaaccttcaattggctgaagctatttggatcgaaagtaaccgtcttctcctcgtttgcggccaattctaccggttgctcgaaagtgatatcgccgatcttccctgtcaatacaccctttacaggagcagcatcatggttcttcacgatcacttccggagtcaaggtagcggaagtcgtatccggcaacggtaatacaacctgtacgaacgggtcttgaatcgttaccttgcctgtagaagtcaagtacacatcatcccaaatacctatattacgaccacggatcgtcgagatccaatcccaaccgatcgaagcgtggaaggttgggttatcagcgcctaagataccaccgttgaaatccgtattcttctcacatttctccttgatagcaccgatatgctcattcttgatgatctccactgcgacaacgttcttacccggtacgaccctgtctgtaacgtcaaatacacctcggataaacgctccctcgatacggccgatcttgttaccgtttaaatatacattcgctttccagttgataccatcgaaattcaagaacaaacgatcttgcttgaatccttcgggtacctcaaactcatccctataccagaaattagagttgaagaatgactcggatatctgcatcaggttatccgcgtaattcggattcgggatagctccgatattcttataactactcaataccgttcccggcacagtcgccacgatccaattttccggagagaaagaaggtttcgatatttcctcgccggaagcggttacctcggaagctcgttgtactttccagtttccgcccgataaacggatctcgtcttttgtagcagccggagcagcagccggttgggcaagcaagccacctttacccatcacctctatctcgcttaagatatagcgtccgtcattagccggttgctccatccatacccgtacgtagcggccttttccttttagcttgatctcatccagattagcatctccacccggaagattcgctatgtcaacccattgtttagcgtcgtcggaaacttgaatcttacccttgatcgctttattgatccaatgtaattttactttgtcgaattcggattggctacccaagtccacatagacccactcctctcctgtcgtggcactcatccaagcgctattaaagaatttggaaggaagcaaatctatcaacttatcttggttatagaaattcatctcgaagaatgcccaataagcggcaccttccattttcaatcgcatccgataataagcatattcacccggttgatcgaatgtcaaagtctcattcaacatacgggtgggcaacgtacccggatcccagctattcttgttcgggtctgaatgggccttatacttgctggccttacccggcatacctttaccctttaaggcagccaattccgtccaagtatttccatcattcgatccctcgcaaacaatctcatatccatccttaatattattctcatcataagccacgctgccgcggaattgtaccttgtcggctttctctttccagttattcagcgtgaacaggaaataggcatcctcgcctgtaaccgcattacgagaataaggaccttgatcgatcatccactcacgctcacgacgagctatatccccattttgcgtggagagatcgagatactgaggttgtttatcgctaataacaccatccgtcaccagttgagccgttagattgtaatcataactggaggagttgtaagcgctacgcaaaagagctatgttacgatacgtggaataatccggacgtaatgaaggagaaaaatcctcccccggatctcccggatacgaaccgatacctctggtataataatccgaccgatcgaaagattccgccggaacaccgctctgcccacatcctcctagcaatgctgagaccgctaccgctccacaaagcgtcaagagtcgaggcaattttttctttttactgaatgttctcatactacttattgtgtttctctaaattagttagtttaataagataccgtcacgtcaaaaccctccttccgggcccgttctgcaatcgcatctaattcttctttagtagcttttttcaaagctttaaccggggtctccctatctatcgtataaatcatgacttgtttcggacggatttgttttaaggcggagatccagcccgctatctcctcttctgtcatattattaaccgatttcccattcacttcccccttcaagaacatggtctgtataatcaagtttccgttaaaacgacataattgctttaataaagactcgaaattaaacgccggagaattaggtacgtctatctgccgaatccgactgtctaatacagaatccagtttcaatatgttatcctctattttattcaaggcttgaaagacctcctctttctggagcatcgtagaattagaaagcacggcgattttagcatcagggaaaaatcgatcccgggtagcgatcgtatcatcaatgattccaccgaattccgggtgtatcgtaggctctccgtttccggcgaatgtaattacatccggagcgatcccttccgctttcatggaacttagtttttgctctaaggcttccctcacttccgtacgagtaggcagtttactatgggtcctatgattctcattcaatccacattcgcaataaatgcaattaaaagagcataatttcccgtctgtaggaagtaaattcatccctaaagagacacctagacgccgactatgtatcgggccaaatactattttatcaaaaagaattgtagacatagcgctgtttgtttttacccacgcaaatctactctaaaatttccagcgaagcaaagcataaagatctgttttatcagaaccgcttatctcctccgtatcagtacctatcaaatccctgtcccaataatgggtgtaagccagtttcgcagataaggataaacgtttccaaatatccagacgaaaggtaagggcaaaccgcatcccatccccataaaaagagggcatattaaaggcatacaatatattcttctcatacgaactgacccggctattgtaatcatccgtatgaaaccacgctagataaccatccatttgaagaggtagggtagtgggcttccagcctatactttgggagatcataattcctttattaagtttctttataggatcatcgaatagaataccatctaaggaagtcttaaaaataaaaggagaagaaaagttataaacctgttgaaaacgaatacgatgttgtttataagaattgattctcaataaattatcattttcaaaagttctattcttttctttttgccggtatttataacgaagataagctgaatagtttctactaggggtataatctatctgagccatatattcctgtcctccggaaggagcgtctatcccgtatttcaaccaaggaaaacggaataagtccgcataaatggataatttccagcgggcgatcggggttaattgcaatcccatataaaccccttgctcattctgaaccgtagagccttgcgagaaagcgttcccaaacaaagcttgataacggcgatcgtaatagcggtataataccaagaaagatatataagaagcgggtgttaactgcaaggcattcaaggtagaaatagctccgtttttcgaaagagcggtctcgccataaaacttaatacggttacttttcaacatatagtcaacaccgatgttgaaattgttggaacctctgaaatagaacaaattataaggttttggatcggggtccatcttaaacttaccgaatgaataggagagagccgttaaacctacatgaaaatgagatgtagcatagcggatatttcctccatatacctgcatcgttatcattttcctcttttcccaatcccgttgtaaacgatgaagtccatccgtttttaatgaggtgaatgtcaagctatctacggccgcatccatttttcggtacgaatagaaaacacttatatccaaatttttaatcgtgatcgtactagccacccctcggaagaaatcctgttcattggttgagaagtgcctacggaagccatttgtccttcgctccgcttgagcgactactgccgtacgactaggagaaaagtcattgctaatcaccagaccttgtccgaaagacatcttgtaatcccctatagccaagctttttaaccagttgatatcttttaggaatagatgtgcggaataaaagtcatatcctttatgatatgcgttccaaaaaggttcgcccgcatctttctcggctacgaagcctgcttgtaaacgatcctcgaaagtataggaataacgtaaggagtgatagaagggttctcctctatatttacgattcggatataacaaaagtatgctgtccgtttgttcaccatatccctttttctgttgaaaacattgatcatacctgatttgtaattcattacgaccatatttcaacaggttcttaaccgtaagcaaccgtttttcaacaagattatcacctatataaacaaatggaaggagaagagatatcgtctgaaaatcgatatcctctatattcttcaactcatagatgctaaccatatttccgtatcgtttccgataggagaggagctgctcaatttggcgatcggatagaaaaggtaatcgcttcagttgttcttccgtcacggcattcaaatcaaaaggatgctcaattaaataagataaatcggcatacaaactttcgatacgctccgtatcctcggtttccaaggctagttcctctacatactccatccacttatcaacagaatattctatttgagaattagcgtaataactatttatcaacagaattatcgacaagattataaacaatcgtttcatagctaagtatcatttaaaaagagaatgataaaccaagaccagtactcatccctaaaatcggatggtaaatagaggctacatctatcgtaaagcaagaaaagttataaccaattcctaaagagggcaggagaggagcggtctgtattccggcacgaataaaaaaagaatcgaaagcggtgtattcaagacctaagtttccaacaactaggttttcattttccgttcctgcacttcctgtaattaacagactgtttataatctcccattgaaaacttatttgaattaagtaataattaaaatcttctatttcaatatctttatctcctatagaaacagatggtaaattcattattaacattcctattaacaacttatcaataggagagaaagtgattccaaaatctgttgacagtctggatcttgtattttccaatagatcagtttgcaagaaactatagtgaactccaagccctaacgcccattgatcccccaagcgttttcctcccagcacacgaaccatcatctccctgtatttatcaaacccgaaaacagagatatcaacacctacggataatagttgattcggataataaaaactaccggacatcgtacccagttctttcaacatgtaccgattaaagtattctaaatgaatggactttttctctttatcgacaataagggccgaattgaataaaatagattgcgtcgccacattccctcccattcccacgctacggacatccggtaagcgtaagttatcaacaccatgtacatacaatgaaaatacccccgcaaacagggatagcaatagatatttcatagttaagattttgtatggtttctatttattcttcaaggttttctcattatccttatttactctacgctgtacctttttaatatcctcatccggggaaagttgttcaggcttaattcccctttgcaatagcatatcacgaacagcggtgttgttatcaatatgttctttctcaataggagattgtccatatagatccttcgtttgcacatttacgtttgtcatttccgccgctaggtctttagcttttatacttatagtcggtaaaaaatcagcgataggtctattcgtggggacgttcattctctttttcaacatctgtgtacttaaattgaataaggcttgatctcccttagaacggataatagcgaatcctttattatcaatgcctctttcgtataaaataccagatagttgcttttcagtctgacttaatttttctctagcctttaagcgttcacaatccaataggcgttgttcaatcacctcggccttacgggtttgtaccgcaaaataagtctgtgcaaaagctacttgcggtttacgactatcaccattttgtgcgattaagtagcatgcgtagcgtgttaataagatgtcatttatttgttgctcagcaccatgccccacaataatcactttcccgacgtcgggaaagtgatcctctatattttctcccgcattccggcacgcttctttggctttcaccactacattattgataaagttatcccatttggcatatcctaataggggttgcaactctctggcactccagcattctatgccttctacctcacatgaaatggattcgaattttccgaatagggcggtaatttcttctttcttcatagttaatatattcttaagttgttgtcaattgcgcaaatgtaatgttttatattcatttagcaagttattaacagataaatgatgctgagagtcacgcagtatttatattttcgcggtatatgatacgaaaagggatatattgtattttggctctactcgctctctgtagctttaaagggatggcgcaggcggtaaagacaaatattgttccggaaggttatcagaaagctcaactgtatgaaggtgatacaatggctgtcgtcaaccttcgggaagttttcatatatcctcaagttaagtttaagaataagcgtgaacaagcgaagtacaataagttggtacgagacgtaaagcgtactttgccctatgccaagatggtgtatgatacgttgatagagacctacgaatacatggaaaccttaccgaatgacaaggcccgccaagcccacttgaaacggatggagaaagagttgttcgcccaatataaaccggaactaaaaaaattatccttctcgcaaggtaagctacttatcaaactgatcgatagggaatgtaatcaatccagttacaatttattgaaagcctatctaggaagtttccgtgcgggcttttggaatttcttcgccggaatgtttggagccagtctgaaatcggaatacgacccgaaaggtaaagatgccatgaccgaacgggtcgtcgtattggttgagaatggtttaatctgatagttgcttgaagaaatcccagatcacgataccggtagtaaccgatacgttcaaggaatgctttgtaccgtattgaggtatttcaatacatatatcacagttatcaaccacattttgttgaacgccttttacctcgttacccatgacgatagcgtatttctttgtcttgtctaactgcaagttatctaacatgacactaccttccgcttgctctacggcacataccgtatacccctcttggcgcagtttatcaacagcctccggggtatccttgaaatattcccaatctacggtttcttccgctcctaaagcggtcttatggatctccgcgttcggagggcaagccgtaataccacaaagataaatagcctctacccggaaagcatcggaggtacgaaacacggaacccacgttgtttagacttctaacatggtctaaaacaacgattaaaggtatcttcttactttccttaaaagcctcgggagtcaggcggttcaattcggttacttttaattttcgcataacaaatatctttgaccgcgaaagtagcgaatatccgtggatatgccgttgaaaagctattaataagtagtggacataaaatgaaaaatatttcttgctttattcaaatacttgtccatacacccccctttctcaaattagcaaatgaataagccacttatttactacgcactatcaacagcccttatacacctattgacagccttgctggaggatctattttttcacaatcaaggttatcaacaataaacagctaaatattcataaagtctataactataagaattacaatctatagatagacatccatgctgttggtatccttttgataaaccgttcacagactttaataagtcaataaccaaagattgtaacaaaaatgtattaaccatttcaacagcctattatattcatcatatttatttttaaaattaaagattaataagaatataatataatgattgtggataactcttgaggggtgagggcaactcatccatcggtggcaaagataagaatctttcttgttatttctataaatgaagaaagtttatacctttgtgctttgtgaacaataggttgataaactagataagatgaagattatcagtaatactttctgtggataatattgtttatatatagtgaaaagcctattgggagcagtagaaacaggaatcattaatatataaggctatgttgacaaaccaatcaatcgggtacatggatgcgcccgttcctaaggatttagaccttaaggaagcgatcgacaagttacgtaaagagaagaatgcgattattttggcgcattactatcaaacaggcgatatacaagatatagcggactatgtgggagacagtctggccttggcacaatgggcggctaagacgaaggcggatatcatcgtgctttgtggggttcactttatgggagagacggcgaagatcctctgtccggataagaaagtgctggtaccggacttgaatgccggttgctccttggcggatagttgtccggctacggagttcgccgagttcgtcaagcaacatcccggtcatacggtaatctcttacgtgaatacgaccgccgccgtgaaagcggtcacggatgtggtggttacttccacgaacgcccgccagatcgtggagagcttcccggaaggtacaccgatgattttcggcccggatcgtaacttaggtaattatatcaatagcatcacgggacgtaatatgttgctttgggatggcgcttgccacgtgcatgagcaattctcattggagaagatcttatctttgaagaaacagtacccgaatgcggaagtaatcacccatccggaatgcaagcagccggttatacaggtctcagacttcgtaggatcgaccgcggctttgctgaagcataccattaagtccgacgcgaaacaattcattgtagcgacggaaagtggcgttattcacgagatgcgcaagcagagtccggataaggaattcatcccggctcctccgaacgacagtacttgcgcttgcaacgaatgtaatttcatgcgcttgaacacgatggagaagctatataattgcttgaagttcgagatgccggagatattcgtggacgaggaggtacagaagaaggccatcaaaccgatcaagaagatgttggagatctctgagaagctgggactctgatccaaacaaatacgggataggtctcaaccgataggccggacttgagtgatataaaagctaagcccggtctattatatgtaaataatcaaaattatgtacaatatctacaactatccttataattatttgattttaaaatatttatcctattgttgtagataggaaaacatctacaatagtaagtctttatctaccatcatttcccgcttttagtaagtgtctttgccatgccgtcaaaggaattttctacactctacgtatataatcagtccgtttttcttcctttctttatatagataaaatattaatatataagtatttgtggttttttatggtataaaacaaaagttttacacatggaaaacatttgttttcatagaagaaaactaaagttttgtactgaagaaacttctgttttcccatatagaaacttttgtttcgctaggaagaaaccatctgcttcgctactcgaactcggacgatcccgggaaagaatatatcaagaatgatcgctattaattaccgtaacattctgaatttagttacttttgtgtagaaatctaattgtaattctcaatatcatgaaaaagataggactaatgttggccttattatgggtgatttgtgcgctctcgtgggcttcttctccggatgcccgtattaaggggcagttaatagatgcctctacgaatcaagtgattaattatgcggatatctttctgtttacgatgggaagtgaaaaacctttgcaacagacttttccggacgatcaaggacgtttctcgtttactaaggtggctccgggtaattatgtggtcatggtccgtctgatgggatatgatgtgtttacaaagaatgatatcatcttggatgcctcgtctccggtggatttaggtaagttgatgatgagtcctttggaggtaggtatcgccgaagtggaggtagtggccgagaaacgtcaattggtttataagttggataagaaagtggtcgaggcctcttccaatatgatgggaggaggcggttccgccgtggatatattagagaatacgccttccatacgggtagacgcggaaggcgatgttacttttcgtggaagcagcggctttttggtttacatagatggtaagccgagtgtcttctcgggtacacaggctttggagcaagtcccggccgggcatatagagaatatagagattatcacgacgccctccgccaagcatgatacggaaggcgacgtgggtatcattaatattatcacgaagaagcattcccagcggggattgagcgggatggtgaatctctcgggaagtacgtggctttcccgccatgtcgatttcttgttggcacagcaacatcagcgttcccgttggtacatcggcggacagtggacagaccggttgcgcaagagtgatttcgaccaagagaagatgacggtggtgggcgatcagaccactacctcgcattccgtcgggcctcgtacgggaaacagctatcattatacgatgaaaggcggttggagcctgaatcttcccaagacaaccatcgcgttggatctggagggcggctatggcggaaataagcgtaagggagaaatgaactataaggaaacccgttcggtagcgggcggctctccggtgacggaagattatcgaagcatagatgattatgataatgatgagaatataggtttgggaagtctggcggtacagcataagttcaacgataagggacacgagctttccggtagtgcttattacaaatatggcggccatgccttggaatatttctttaacgacttgatgtccttggaagggcaacgccaacaggggcaccgtgcttatgaggccgagcaccgggaaacgatgcgtatcaatctggattacgccttgcctttcgggaaaggaggtaagctagaggcgggttaccaatattattcttatctggaagacggcgattacaatatggaatggtgggaccccaagggacaaacgttcttttggcgtgacgatatctacaacacgttttattttcaagaaggggtgaattctatctatacgattctttcccatacgtggaagaatttagaggcgcaagccggcgttcggggagagcatacgcatacggtcttgcgaagttccgtggagggagcggatcgtacgaagaatcgttttgagtttttcccatcggtgcatttgggctatacgttcccgaatgaacatcgtttgttggcttcctattcccgtcgtaccacacgtccgcagcttttctatatggagccttatatcacgtatcgtgacttttatacggccgagatcggtaatccggatatacgtccggagtacatcaactcctttgaattgaactaccggaagagtttcggggaaaacacggtatccgccaccgcctttcatcggtatcggaaggataagatcgagcggttgcgtgttccctattcagctggtgtaaccttggattcgatggcgaatgtaggacatgattactcgacgggtatcgagctaagcgtcagcctgcatccggtgcgctggtggaataccacggtcaacggaaacgtttatcactataaggtgaagaacgaacaggccgccggtggaaatacgacctcaagcaccaattacgatatcctatggaataacctgtttaatctggggaaatacacccgtatccaattggatggtagttttgtaggcccttccgtaacgacgcagggccgtacggacgcttattggtatgcgaacgtagccgtccgtcagcaactatgtaaccgaaaactaaccgccaccttagctttccgggatattttccgttctgccaaatatatcagcgatatccaaacggcagatttacgctccctgacacgtatcaaacccaaatatccacaaatcacgttgacgttgagttggacatttaatagtttcaaggctaaatccacccaagcgaaagaagatcgctcggagatgtttgagggtataaagcattgatattgtatctttactatattggtttgtcttcgggaaacaactacgattgcaaataaattctgcagtcgtagttgtttccctcttttacggatggtggaatttggttcttggcattaatcgctgcgaaaggagcggagaagataacagatcagatcatccggtcattgcgttcttctaggctttctttttaggatgatataaacagggtttctctatgtatttccaggataacatacccaatccggtgctaaggatagtggtaagagccaatgtcaatataaagctataccgatcaagtccgtaatgaatgaatatctggatgatcgggaaatgaatcaagaagataccatacgagaaatttcccatccgattgaatacatgtaaccacttgaatccataagctaccgtgataatgatagaggctagagcgataggctcgaaaatactcagcaacagatactctctacccaataaaagaaataggctgacagggaacaaatatctcatatattttcgaaaaatagggaaataggcaagtatgataataccagaacaaaagtacatcatttgtccggggaattgtcttttcatgaattcataaatagggttgtgtgtcatatcatctaaataattacacgttgtcgagtagatgaaagataagatataaataagaagtaggcatactaatttgttatatcttttcagtaaccaatagataatgggtatggtgatatatagcatgaattcaaccttgatagtccataaagacccattcatcgcttgtaaaggattggtatcgaatacgccgggtaaatccggcgataaaaagttaaatgtaagtaaattacagataagataggtgtataagctagaagaggtgaggtattccctgcaggataaggaagtaaggaataatccgattaaggcacataataaaatagtcaagctgtaggcgggcataatacgttgaatacgtttacggaaaaaaatccgggtattaggcgtacgtaagaagctaaacataacaagaaatccactaataataaagaaacctttcactcgaaatcctccgctaacaaaccaaaaaggatctgtctctgtcagtgtgctgaaatggttgaacatgacagaatacgcaagaaagaagcgaataaaatcaaaattattcgcttcttttacttgatttattaatctggagttgagtaaaactttctctgattgattcattgttctatttgactacaatgatttttgttacaacgctctctgaggcttcctctgtggaagctagtacaagatatacgcctgtcgctacacgtgatccgcttgcgctccggcaattccagatagcttgcccccccaaggatttagtttgataaataatatttccgtttaaatccgtgatttttacattcgaattatccattaatcctacaatcgttactttatccatatgttcgggacgtaccggattaggatatgcatagatctccgagtaatcagatttaccttccgaagcttctccttgataggaatttagtcctttatcggtaccgataaaaacctcaccggtcttatcgtttatctctatatcgtatatgttatcggaaaggagcgggctattggtcgtattaaattgataaacgattgtctcattatcattatctagaacatagacgccatttcctttggttccaatccattttcgattacctgcgtctacttttagggtcgtgacaacaacgttatctaagaaataagcgagattaccagtttcctcattggtatattttacccttgtacaacgtgtagcggctttatcctcagcggaagagatcctaggtttagtgaaatatacggccccccgattcgtaccaacccagatatatccatccttatcctcggctacgcatgtataattactaggagtcaattcttttccgtcggtatcaataagtgtagtaaactcatacgaggaaacttcatctaaagactcgctattcggtatcattacaagtttaggtgtgttacgaggcacataaatccatttgtcgttagtggaggttataagtatatcgtttattgtataaactcctctaagttgctcgatatccaaacgatgccatgctcctgctttgtcaagaacaagtaccgcatggttaacctctgagcttgtcatccacaaatttccatttttatcaaaggccagtccatctatataacaataaccggacccatagcctcctgcggtttctttaaaggcattcttttcattgtatgactggacgggagttccattcttatattggataacgccatcacccatggaagaggcgtatacgatctcatcattagaatcatcggtcgttacggctatacttgtatagtctcgtggatttcttggtaaattgagtttcttttgggcttctttaggatcgataaaagaccatttatcataatcgtatgtaagaatataacctcctttgtcgaagcgcttaccatttaggaggtctttacctcctatgatcatatatactttatcatttttacaaacaatatcgaatgcgctattgctgtaaggtccgtctaaaatgataggttcattaagagcctcaaaactatttgatcctttccgttggatagaacgtagccctttgcttccttccgctatccaatatttgtctgtttgataggtactgatatcattgatacttaagtttatttggtcaaacttttgcgtatcggatacgatgaaaacccttgagttatctatacatgctaatttttcgcctattactttcatgtattttagggttgagctatttattattcgggaaagctctccattgttttcatagaagataccttgctgactgaccaagtagaacaaagtattcttgaatgaagcgatagctgagatcgtatgactatcggaaaggtttgataatccatagggcttccagtttgccttatccagtaggttctcttttaatgaggcgtatataatccccgaagatacttctgccttattggttgtagaggcatatatattgccattctgtatggcacacgatgttatatttaaggaaagcttgtaggtatcttttatttcctttttggccatattgaccacgacgataccaaatgctgtcgataaataggcatattcatcatgtaccaatactgaattgatttgtttgtctcttatggacgtactggtcgacagataaggtagatttgtcgccactcctccctcaagtatatctatatttgaattatcatagataataaggagtgattttgtttgtttattatagcggatcaaagaaatcgtattatcatttaatccgtttcctttataatattgcttaatactattatcatcttttccatacgtataaagagatccttccgctaccacaaatacttggtcgttcgattcctctacgctgtttgtgttattgtaagaaagatacgttttccatccggttgtattaaaattagcggctaatacagtgaatgaaaaaaatgaaaatagaatgatagtaagtatatgtctcatattaacaattgtaatcagataaaaatgatgttaacttcatgacggctttcgcacgatggctgatctggttttttgtatcgttacccatctcggcgaaagtttgtgtataggtatcaggcatgaatataggatcgtatccaaatccgctatctccgcgtttttcggtagtgatagagccattcacgataccgtcgaaggtatattcttttccgtcaaggactagagctatgaccgtgcggaaacgtgcttttctgttttctttatgattcatttcggacaacagcttgttcatattagcttccgagtcgtgccctgttcctgcgtaacgagccgaatagactcccggagcattattcaatacctcgacttctaatcccgtgtcgtcagcgaaacaatcatatccgaatttctccttgatatagcgggcttttagcaaagcatttccctctaaggtatctgccgtctcggggatatcgtcatggcaatctatatcggataaacttatgatttccgcgtatccggcggttatcttgcggacctcgtccagtttgtgttgattatttgtcgcgaatacaagtttcatatttcgtaatctattaaataagaaagcatttctatacggtagatatataacgtatggaaatgctttaaattgtttgtatattcttttttaagtctttatctgatcgaacccctcaccatatacccctcggacaatgctttgggagatgaacgcttggtggtctatccgtttcacgatccggaagatggagacggattcggatttcttggcgagtagtacgactaccttgacgggtttgcgggaataaccgccctcgccgtccagtatcgtacagccacggcctaagtcatggatgatgcgatccgctatctcgtcgtacttctgggagaagatgaggaattgtacggattggcggttaccgttcaataccatgtcgagaacgtaattgcttatgaccatctccacgaaaccgaaaacgatcttgtccacgttatggaacaggaagaaagaggaactgatgatgaagaaatcgcaaaacagaaggatacgtccgatcgatatattcttatatttattgattaccgcaccgataatatccgtacctccggtactaccgttcgccgagaataccaatcctagtccggcaccacacataaacgctccgattatgatagccataaacggctggtcgtgcagtataggttgtcctttcagcagccactcgaagagagagagagaagccgagagtgagaaaactccgaaaatagtttttatcaagaattttagaccaaggatctttaaggctaccaccaacaaggctacgttgatgacaaaataagatacggataccgggatcaatccattggaggcaaagaagatcaatgcgcagataccacttaccccacctgtcacgatctcgttggaaaggataaaggcgttgaatccgaatccgtataataaagttccgaacaggatcattagataatcctgtacggaaaaatagatttttgtgagttttaagttcatcccactacgatattaacgattttgccgggaacgacaataactttcttaacggccttgccttccatccacttcgctgagttctcatgattcaaagccgctttctcggcgtcctccttagaaatatccgccggtagctctaggttgtagcgagctttaccattgaatgagatcgcgtaaacaacggatttctccttgagatattcttcgttgtgtttcggccaccgggcatcgcagatggtcgtatcatgtcctaattgatgccatagctcttccactatatgaggagcgaacggagccaataaagtgatcagcggctccaagatggcgcgcttgctgcattttaagctcgttaactcgttcacgcaaatcatgaaggcgctaatggacgtgttgtatgagaaatgctcgatgtcgaacgttactttcttgatcagcttatgcaaggatttcaattcgtcggccgtaggctcggcatcggtaacttgcagggtatccgtattgccgaagaacaagccccaaagcttctttaagaaacggtgtacgccatcgataccgttcgtatcccaaggcttggattgctccaacgggcctaggaacatctcgtacaaacgtagggtatcggcaccatatttctcaacgatcatatccgggttcactacgttgaacatggatttggacatcttctcgaccgcccatccgcagatatatttaccatcttccaatacgaactccgcgtcgttgtattccggacgccagttcttgaaagcctctatatccaacagatcgttagatacgatatttacgtctacatggataggggtgacctcgtattggtctttcaagttcaaggaaacgaatttattggttccgttgatgcggtacacgaagttcgagcgtccttggatcataccttggttgatcaatttcttgaacggctcttcctcgcaaacgatacccaagtcgaacaagaacttattccagaaacggctgtaaatcaagtggccggtagcgtgttccgtaccaccgatatataaatccacgtttctccaatattcatccacgtctttagctaccaaggctttatcattatgcgggtccatatagcgcaaataataagcggaagaaccggcgaagcccggcatcgtacaaagctctagcgggaagatcgtctggttatcgatcttcgatacctcggtgactttttggtttaccgtgtcccaagcccatttaacggcgtgtcctaatggaggctcgcccgtctcggtaggcaagaatttatctacttccggcagcaacaggggcagacattcttccggcaacatctgaggcatgccatcggcgtcgtaatataccgggaacggttcgccccaataacgctggcggctgaaaatagcgtcgcgcaagcggtagtttatcttcacacgtcccagatcgtgatcttttacgtatttcttggtagcggctatcgcttccttgatcgtcagtccgttcaaggaaagatcgcaataaggagtaacgccggctctcggagaattgcatacgataccttccttggcatcgaaactttcctcgcttacgtcgcaaccttccaccaaggggcggatttccagtccgaaatgcttcgcgaaagcgtagtcgcgactatcgtgcgccggaaccgccatgatcgctcccgtaccgtagccggccaatacatagtcgctgatccagatgggaaccgcctcgcccgtaaacgggttaatagcataggaaccactgaatacaccggttacctgacggtcggcgatgcgctcgcgctcggtacgtttcttggtacgatctaggtaagcgtctacttctgctttttggtctgccgtagttaattgttgaaccaattcgctttccggagctaataccatgaaggtaacaccaaacatcgtatcggcacgggtcgtaaagatcgtgaattccttgtcgctgtcttttaccttgaagcgaacctcggcaccttcgctgcgtccgatccagttcttttgggtctctttcaaggaatccgtccagtcgatcgtatccaatccgtccaacaggcgttgcgcgtaagcggatacacgtaagcaccattggcgcatgatcttttgttccaccggatagcctccacgctcggaaacaccgttcacgacctcatcattcgctaatacggtacccaaggcggcacaccagtttaccatggtctcgccacgataagcgatccggtagttgagtaatatctcttgtttttctttatcgctcttggctttccattcctcggcggtgaaactaagttcctctccgcaagctacgttcagaccttccgtaccactggtctcgaaagcctgtatcaactcgctgatcgggcgggcttgtttctcgtcgttgcagtagtagctgttgaacatccggatgaaggcccattgcgtccatttgtaatattcgggatcgcaggtacggatctcacggctccaatcgtagcagaaaccgatcttttccaattgctcccgataacgggctatattgttctttgtcgtgatctccggatgttgtccggtctggatagcgtattgctcggcgggtagtccgtaagcgtcgtaacccatcgggtgcaatacgttaaaaccttgcaaacgtttgaaacgcgaataaatatcagaagctatataaccgagcgggtggccaacgtgcaatcccgcaccggaaggataggggaacatgtccaatacatagtatttaggcttattcgtgtctttttcgactttataaaccttttcggcaatccagtagtcgtgccacttcttctcaatctctctgaaattgtactccatgatcgtttatcgtttttgtatcgttttctatttaaggccacaaagttagtgaatttatttattttatatgagttatttacatgaactgtttatttcacgtaaccaatccgggggcgagattgattctcggttcttttcgcttgtaactcagcgagtgacagattgattagctcaagttgcgtacgggtatcttcgttgatgtcgttgtaatcggcaaatgcttcttcgatatacgctttgagttcctttacttcttgttggagttcaaacaaaggggaggaagaacttattatttgtcgtatgccgacgaaagcacgcatgatagagatattgactttaatggctgtatcggatctgagtacagaagaaagcattgctataccttgctccgtgaaagcgaatggagcatattggttacctcctttctttgagatgccaatttggcataccatattgtttttcaagttgttaaattcttgaattgttaatgtgaacataaaatcatcaggaaagcgttctatgtttcgtctgaccgcacgtttcagttgggcggtttctgttccatacatttccgccagatcaaaatccagcatgactttttgccctctgatctcataaatcttgttttgtatcgcttgtaattccatagtataagaacttattagtttactttatttgatataaccaattttaggtcttttagcattgttctttttctttgtagccagttcggaaagagctatgtaaatattatccaaagacttttgggtgtcttcactgagatcattgatagcgcaaagggtttcctcattagccatttcaagagatttgatacgttcttgtagttctttaatttcgatggaactagtggtagtttgtaaggtataattccggatagcgacaaaggctctcataatgtttctgttgatttcgatcgcaatgtctgagttcagcacactacttagcattgcgactcctagttccgtgaaagcgaatggcatatatttaaagttattacctctacctttattcaaggtcacaaattgtgatcttgaaagttcctccttggtcaattcaaacataaaatcatttccctcgaatcgtttaggattacgcctgactgcctgtttaagtacccttgtctctattccatacatttccgccagatcaaaatccagcatgactttttgccctctgatctcgtgaatcttgttttgtatcgtttgtaattccatagtaaagattttagtttaatattatgttcgcaaaggtttgtaaaataattgagataagcaataagctagttggatatttatgattggttgcatttgtaagttgtacaatgaattattgctgatccggcttattgtctattttttatgtgttcttattttccttataagatttccgggaaaaacacgtacgtgatttatgaaaaacacgtacgactttttggaaaaacatgtacgtgttttccggaaaacatgatgatgtttttatatcactgatattcatgtatatataacttgatacctttgcatggacttattgtgtgttttttcttcttgtatttgttattttgttgttctatcgtttgtttatgaattaaaaatatttaattttgcttatctataataaaggatgaagtcatttatatatatactattaacttccttgactttccttgtggtaggatgccaaaatgaatctgaggaaatccgtttgatcaatcaggcggaacgcctgtttgatgcctatccggatagcgtaatcactacattggattccattccgctcccggaagagatgagtccccgtctgatagcccgttggtgtatgttgtacgcacgtgccgccgataaaatagaggacgaaatgccttatacgaaccagcttgagatcgccttgaaatactatcaaaagaaaaagatgcgggaagaggaggctgagatcggcctttatctggggcgttcgtatgtggaggataaggagtacgagaaggcaatgagggcttactccgatgcgctggaggtagcgttggcgattaagaactataatcgtgccgggtatatttgtagttatatgggggatttgtatgaactggatgatcgttatgtgttagctgcaaaaaaatataaggagagcggacggtattttcgattggccggtaatatgaaaagctatgtgcgttcgtttgtgaatgagggaaggagttatatggatgttgattctaattatttagctttaactatattgaagcgagcagaagtgataatagattccttgagagtagatgaggttagaaattatgtatacaatggtctaggtaatatatttaatgttttggaaaaatatgatttagctgaaaaatatttattgaagagcataaaagaggattcgagtgatactgcttcggattatttgaccttatcagatcttgagcaaaagcgtggaaatttagaacaagcggaaaattatcttcaaaaggctaatagtgtatccatagataatgattttgtaccggctactattgcttatcattattataaaataaataaagaaagagatgattataaaagagctttgtctttttatgaagaatatgtagcagcagaggattcccttatgaatataagtaaatctgtcgatatatatgatacagaacaaaaatatgaacatttgaaattgcataatgaaaatataagattactattaaaggggcaaaggaattatacttttatattgatattgttatttttatgtgctttactcattattgtctatttagctacgataagaagaaagaatcgttcacttttaaaacaacaagaaaaaattaatactttgaatcaaagcatatatcaattatatgcagaacttcggagaaagagtgatgaactaatccaattgcaaaatactcagtattcttcggtgaaaatgcaagtggaatatgaaaatgtacagaaagaggtagatagcttgagatctcgattattcgaattaagagaatctaaaattctcaatagtaatttagctaaaaaaataaagaaaatatctcaaactgtgcagcctaatcattctgaagcacccgtttccgaaaaaatgtggattgatattgaagttttgatgatggaagtttaccctagtgttataaaggtactgaaggatgcaggcttgtcaccatcggagatgcatctttgtttccttacattatttaaacttgattcaacagctatatctatccttttaaatattattcctacttccgtcgatcgtacacgtttgcgagtacgaaagaaattaaattgggaaggtaaacaaggattgtatgaatctcttgttaatatttagtatgtaataaaccttcatttaaggggctctacgattgtttgtctatgtatttgtttttatagtatttgattgtcaagtgtttacgtttttttctttgtctatgtggattacataatttaacccctttagatcatatataatctctagatttgcaaccgaaacataacaaaaaaagagagattatgaaaaatgtaaaatggctactaacagtgttgtttattttttcaatttgtattccatcttttgcaggtcatgtgcctttacatggtcatcttaagaaaaaacagcgatctgtaaatttggatgtacctataaaagcagacatagatgaaacttcaaaagttttgtctttggagtttttagaatatataggagaggtacgagtatctgttgtggatgcgaatggaaatatcgtttatgaggagatagtggatacacaagatgtttcttctagtattatctcattagatgaatgtacttctggatcttatggactttatatatcagattcagaaaactacgcagaaggtttttttaatttataaataattcaaattttagaagtatggacaaaaagacagtgcttttagcatctgcatgtactttattgatgatatcatgtagtaatgatgcggaattgattaatgttgctgaaacgacaggattacaaacaaaggcttttgttggtgaagcagatttccaaattgtagattatgcgggagataaatgtattcagttcaagaatgattccgtctttaatgcgatgctttgggagatgaatgatatgtcagaagaagagagaaataatattttctcgggggcaggtttcgtaagtcaatggcaacttatgcaagaagcagatcaagaacaggagcttattgtagacaattatgagaaagatcttagccaaccttggcctgctcatcaaatcaaagaattcaaacaaaaatatgatgatgttttcatgtttgaaccttatgattctacagattttattgcgcattataaattaaaaggttctacatatagttcttttgtgaatagaaggggggtgtttttgataggagatagtgtagcacatgctcctgtatataaggctttagaggaatatttcggatcagggatatcattgtatggtaataatgaagctacaaatgaaaagaatgatataaacctagctgaaagtaaatatcaaataccaggtggtgattatgtaaaggttcgagctattccaagatttatagagttacaaactattgaaaataaaaattatttgtcattgggctttgattatcttagtcaaaaaaagaaagttttatggaaaaaacaccgtacaatgattatactacgtcttacagcttcagggtcaggaagtggttttgaagtatataatgtttcaattaaaaattatcagaataaaaatggggtaacaattcttttacatacagatgtatataataaacttttagctaaggatcaaggaggtatgttagggcatgttggtgaaaatccaagaaactcagttacaatcgtaactcctcctcgatttgagttttctggacgaatggaaatttggtcagatgaaatgcctgaaagtaataaagggactgcaaaaataagtttaaaagaagactggtgataatttatgaaaaaaattttatttttactgttattggtttctacttctactttcgcccaaattgagcatggcttattagtaggtgccggtgttggatttcctttacaagatagttggaaacgaactacttggggtgatgaatcaaattggtcttatcggcacgattataagttaaatagtatgatcggttatcgctttcgattccttccggaacagaaattcttttatgatttggatattacgatgggatttcagaagatggaaacgacgaagtattttccttattatgaaagtatagaggatggtatatatgtttctaagaaagctgatgttttcgatgagtttgtgatgcctatctccgtagccgctagttggaattggcgttttaccaagaaattccatttaggtgtcggtatcgctcctacgctttatgtacagccacaagccgtgtttgacctgtccgtgatggcgaaggtgggatatcgtttaagcaagcattgtgagttcggcctttcttatcagtatggctgtttcaataccttgaagcatttcaataacggaccggctaatggccgtcgtggacatctttcggatttgatgctctctgtatatgttccttttgttttgaaatgatagaataataaagtatagaaacacataatgttttatttggaaccaaaacaaagatgaataactgcctataagaaaagagtacgtgaaaagagccatgtgtagagagataattctatgcatggcttttgcttgtataatgtatatagattctcaagaattattgaggcattttttgtttgcgatattgtctctctcgtgattaagaactatctttgacaaactatccaatagtggatgccgaatcaaaatcaattgactatgaaaacaaaaaaattgaaattcttcgtaaatttgtggttctttaagcatatcttatagtaaggatcgaatatgaaaatgagtgaaaaggaggttgatacatcaaatgaactacgggtcttgtccctgttctctggatgtgggggcatggatttaggattcgagggggattttatatgtcatcgtaagtctatatctcctcaaagtacctgggttcaagaggttatcgatgaacactgggttcgtttacagaagaatcgttttcgaacggtctttgcgaatgatatattgaaagaggcacaaaccgcttggcttcaatatatggatcgattcggatatgataaaaacgtttataatacaaagagtatcgtagacttggtgaaagagcatcgagcggggaaaaaagttttccctaaaaatatagatgtcgtcacgggaggttttccttgccaggatttcagtgtctctggtaaacgtctgggatttgagtcgaataaggatcataccgggaaattgcgtgaggacgatgaggcctcggaagagacgaggggtaaactttactattggatgaagcaggtgatcgatattacgagacccaagatatttatcgcggagaacgtgaagggactggtgaatctgggagacgtgaaaagtattattcagagagacttcgcccatgcggctggggatggatatattgttttagatcctcaagttttacatgcgggcaattatggggttccggagtctagagagcgtgtgatttttatcgggatacgtaagtccgcgttaaaggttaaggctttaagagcgcttcaagaggagaagatacccaaagcttacgatccttatccgagtccgacacatgcttgcaccgtggaagataagaaactattgccaccggtggtttgtcgggatgtatttgtaggattggaggaaccggataggacagaagatccatcccagcggtattattcacaggcgaaatatatgggagctcattgtcaaggtcaaaaggagatcgcgctggataatattggcccgacgattcgttccgagcatcatggaaatatagaataccgtcgtttatcccgggagcatgggggcgttattacggaagaattagacgccggtttacaagaacgtcgcttaactcctcgagaatgtgctttgatacagacgtttccgccggattatacgtttgtctcccataaaaagaacagtacacgttttgagttaagtgcctcaggcgcttataaggtgatcggtaacgcggttcctccagtattagcgtatcatatagcgaatcgcatacagactttatggccgttgtattttaaaaagagataatatggaagaggagaatattattactgtgcgtaatagaaatcttcaaaaagcggatgaggcttttgcggattttatgtttatgctggaatcatacttgaatgaaaaagcagctgctattccgggtacgtattgcgattgtaagagtaaggaactggaaaatgtagtagtgaacgtgatgaaagaactttgcggtagaactcctttccgtgtggaggagatacgcttggtttccgcccaatattttccagatattatcgcggagaaatattatggggttgaggtaaaatctacaaaagagaaccattggacatctacgggaagtagcatcgtggagtctacacgtgataagaatgtagaaaatatctatatgctcttcggcaaactgggaggtaagacggcggagtttaagtgccgtccttatgaggattgtctctccgatatagctgttacccattctccccgttatttgattaatatggaattaacgaaagagcagactatttttagtaagatgggagttgcttatgatcaattaaggaatgctccggattctatagagatcgttcgaaaatattatagggaaaaagccattaaagccaaaaagaaagctatgccttggtggttgggcacttccgctgaggaaagtttggaggagcatacggatatgaatataagcctgtgggtggataatggagaatatgcggatccggaaaggaataagagactaaaagcggagatatttattttattcccggaagtagtgagtgggaattatgagaatgctgccttatggttatgtacgcgccggtctgttgttaattttcatatgcgggacactttttccgcagggggccaacaattgaaactgaatgatgaacttctgccttttcctttaccgcatgtggttggtgagttgttagaatctgcgactttaataaagaactatcttcttaatagtgatgatttagacttagatatatcggaattccgtccagaacttatgttgcctaaccgatatgaggtctggcttaatgatatttggaaacgtattcatcaactaaaaccttataaaaggaaagagactatcgaagaattgggcggtatttcattggccgaatggatcgataggaaatatactttgtctgtaaaataaaatatatcttcttctcgatcgtctccctaagatcatagatcgtatcaagaagcatacctatcccggaaaaatacgctgttttatatctccacaaacggcttaacgacttgtatatggaattagtaggggattgagacggttgatttagaactaatagcgaatcagaagggttatacaaatacgtaacattaaagtttaaagctatgaagttttttattgacacggcgaatctggaccagatccgggaagcgaatgaattgggagtattggatggcgtgacgactaatccgtccttaatggcgaaagagggaatccggggggtggaaaatcaacggaaacactatttggaaatttgcgagatcgtgggcggggatgtaagcgccgaggtaatcgctaccgacttagagggcatgataaaagaaggggaggagttggcagctttacatcctaatatagtcgttaaagtaccttgtatcgaagcggggattaaagcgataaaatatttcaccagaaaaggcatccgtacgaattgtacgctggttttctctgtcggtcaggcgttattggcggctaaggccggggctacgtatgtatcgccctttgtcgggcgtttggatgatattgccagcgacgggatagagctggtacgtaagatcgtggaaatgtatgattattatgattatgatacccaagttttagcggcttctatccgtagcacccagcatatcatccaatgcgtggaggccggggcggatgtggctacttgtcctttgtccgccattaaaggcttattgaaacacccgttaacggatagtgggctagctacttttctagcggattataagaaagtaaacggatagaaaaaaaatagtacctttgtgcggattaattcgtaaacgcatttaaaagattactatcgtggcaaaagttgtggaaacccctttgatgaagcagtatttcgatataaaagcgaaacatccggacgctatccttttattccgggttggagacttttacgagatgtatggcgaggacgccgtgattggcgcggaaatactgggtatcgtacagaccaaacgtgcgaatggcgtagggcagcatgttgagatggcgggatttccacatcatgccttggattcttatctgccgaagttggtgcgggccggaaagcgtgtggctatttgcgaccagctggaagaccctaagttgacgaagaaactggtgaagcggggtattacggaattggtgactcccggtgtttccatcaatgataatatactgaatcataaagagaataatttcttggcctctatccatttcgccaaggaggtatgtggtatttctttcttggatatctctaccggcgagttcatgacagcggagggttccatcgattatatcgacaaattactcaataatttttccccgaaggaagtgttgatcgaacggggaaacaagaagcgtttcgaggaggctttcgatcctcgtttctttatctttgagctggatgactggatctttacgacctcggccgccgaggatcgcctgttgaagcatttcgagacgaagaacttgaagggttttggcgtacaacacttgaaattaggtattatcgcttccggggcgattctgtattatctggaccagacccagcatacgcatatttcccatatcaccgctttatcccgtatcgaggaggatcgatacgtccgcttggataagtttacggtacgcagcttggaactggtgggtacgatgaacgatgagggaacaagcttgttggacgtgatcgataagacgatctcgccgatgggctctcgtatgcttcgccggtggatactattcccgctaaaggatgtaaaaccgatccaagaacgccaagaggtcgtggattatttcttccgtgaaccggagacaaaggagttgctggatacgcagttggagcagatcggcgatttggaacgtattatctccaaggtggctgtcggccgtgtatctcctcgtgaggtggttcagctaaaggtcgcgcttcgtgcgatcgagccgatcaaggaggcatgtatggcgagcggggaacccagcttatgccggatcggggagcaattaaacgcttgcgccttgatccgcgaccggattgagaaagagattaataacgatcccccttcgttggtcaataagggaggaattatagcgaagggggtcaacgaggaattggatgacttgcgtgccatcgcttattccggcaaggattatttgttgaaggtacagcagcgcgagatcgaattgacgggtatcccaagcttgaagatcgctttcaacaacgtcttcggctattatatagaggtacgtaatacccataaggataaagtcccggcgaattggatccgtaaacagaccttggtgaacgccgagcgctatattaccgaggagttgaaggaatacgaggagaagatattaggggcggaagaaaagagccttgctctggagacccgccttttcaatgagctggtattggccttgacggagtatattccgcctatccaaatgaacgcgaacttgatcgggcgtatcgattgccttttatctttcgccaaggccgcggaggcgaataagtatatccgtccgatcgtgagtgattccgacaagatcgacataaagggaggtcgccacccggtaatcgagaaacaactgcccttgggagaaccttatatcgccaatgatgtctatctggatgacgagaaacaacagatcatcattatcacgggtccgaatatggccggtaagtccgccttattgcgtcagacagccttgattacgctcatggcgcaaatcggttgctttgttccggccgagagcgcccatataggtatcgtggataagatatttactcgtgtaggcgcctcggataatatctcggtgggtgagtctacttttatggtcgagatgaatgaggcttccgatatattaaataatatgacttcccggagcttggtgcttttcgacgagttagggcggggtaccagtacctacgatggcatatcaatcgcttgggcgatcgtggaatatattcatgagcacccgaatgcgaaggcgaaaacgctgttcgctacccattaccacgagctgaacgagatggagcgtgcctttaagcggatcaagaactataacgtatcggtcaaggaagtagggaataaggtgatatttttgcgtaagttgataccgggaggaagcgagcatagctttggtatccacgtggcgaaaatggccggtatgcctaaaagcatcgtgaagcgttcgaatgagatcttgaagcagttggagtccgagaatcgtcaggaaggcatcggcggtaagcctgtaaaagcgatcgcctctgccgccgaggggtatcagctgagtttcttccagttggatgatccggtgttgagccaagtacgggatgagatcaagaacttggacgtgaataatcttacccccttagaagccttgaacaaactgagtgagatcaagcggattatttccccgtaataatccgcttgatcgtattaccgatgattggtaatcgtttactttttaggtctcaccaacactaccacccggttgtcatcctcttccaatgtcgcggccacctcttttagtttgcctttcagctttccccttttatagtcctggcaaagttcggaagcattgatggtagagcacaattcgccttttgaattgatgggaggaaatgtcaccatatagatttctttcttataagaataatcatcgttgtatgtgatatagttgaaaaatttcttttcttgcgtatcgtatgcgaagtactttctcgggaaaccttctccggtgttaaaatcatatatattcgttacgctttccatgaaataataacgatcggaaatcaatcttaagacgacgaaaacgcccggatccatggtgtggatagggggtgttcgtgcgataagcgggcgcaaactgtaatcaggcattaaggtgtataccgtatctgaagaggcctcaaatagaatccaattacccttaaaaggaattatactgttatacggacctggtccagctgctcttgtttctcctttatcataaagtctttcaacgatatggaataattgcttctctttatatggaaccgtgatttctttcgttatacttccatcttgcttcgacacaagcaagaacggtacctcaaaattaaacttatcatagcaaatcaagttgtccttgtcataatcaagcatttccacgtaaaacgaacttttctcgcttctttgattcagacttcgtttgaaatttccttccaaatcatagacccttatctttttcgcatgaaaatcatttacgaaaatctcttcgttttcttcatctaacgaaaccgatctcatagacacgtattcttctccaccttgtcccttgcgatttattttgcgaatagcttttccgttccggccatatacgaaaatattgccatcatcgtaaaagtttgtcacgattatgtatttctcgccaaccgcctgcacgcatgcccgattgataaactcatcgtttgtttccagcggaatatactccacatccatgaagtcttgaaggaccaactcttttttggttgaataactatcgtttacatccacggttataagaccatcggtcgatgaatggtcgcctccacatccagccattacaaacaggatgattatccctgtaaaaatgaatcttttcatatgcgtatgatttttgtttaacttatggtggtgaagatactataaaaagccgatggttttcacgaaattatcctattatttgttgatctcactggtaatttcttgcacatcttggagcgtaaaacgccctaacaattgcatgacgctgaagctcccgtcgtccatgtcggctatcatgatcaactcctgtatcagttctccttgttgcttgacgtagaaattggctttggtctttccatcttttactcgcatgagttcttcatgatcctttccgatcaaggctttgaactcacctcgcattcgttcccttaaatccgctttttgggtggtgagtatttgcagggattctattttccctttcaggttggcaaggttgagtccggcggtttccatgaccggcatcatctgaaacatctttttggagatatatacggaagtaacatcatccatatccgcatatttgtcgaaaagcttgttctgggcaaaacagatattcacgcagcagagaagcagtattgtatatagttgtttgagtctcattgtattaatcatttaaatgtttatttacgatcttgtttatttttgtgatctcttgactggcttcattgacctgcccgagacctttgtttaaattcctagacatgaacgccaaggcattttgggctacgacagctgcctcttcaggatcggtaaaggtatcggccataacgggagccggacgatttgtctccgtgaagatgaggaatagggcgccaagaatagcggaggcgattccgcttatccaatagaaggaacgtcttcgtgagactcggggagatatctcttcttgggctaggaagtcgatttgtcgttccagcctttcggaaagtccctccggtaaggctaaatcctcttggagtgccttgtttattagttcatctatctttttatcatccatgacaacttgctttttctagtttctcccggatcaatttgcgtgcccgggaaagtaatgttcttatattagaggagctaagccctgtaatctgttcaatgtcctcataggaacaatcctcaataccacgcaggcggattacctgcctctggttctcggggagctgttctatcagttcttgtatacgccggatatcctctttttcttccaattccttttccggcgaggagtcggtcgttaatagaacggtctccaatgcctcttcgttgtctcttcggcttgctttgggcgagcgcaggaaatccagacaaagatttttgaccaatgttatggaaaatgcttccggattctggatatctcccagctcatcccttttattccataatttgcaataggcatcttgaaatatgtcttccgcatccgctttattgtctaataaggcataagcgatccgatagagtttaggatgaaagggtaggaaccgttgtttaaaaacatcaacgtccatcagtatcgcccttaataatttccagttttgtgctcattgattacccggtctagatcggacgggctgatctttcctttgatacggattaacgcattgtcgcttcctgtcgtgaatatgaccagttcacggatcatatcctcttttattttgacaagaactttcgtgcgactgtccctttcatttgccgtgaccatcgtctcataatcaggatctctcaggttccgtatggcggtagacagtcggtctttcacctcttgggcacaattatcaaattcaaggatctctataccgtttactcccattgtctcggtgaacaggctggctagcttcatcgttatgtttccgatatttacggaagtaacatcgctttcaccccggaaagcattgaataattgatccatcttctgctgcccgtatcctacttggctgataaggaggatggccagtaacactagtaatcttttcattgtaattgactttttcgttaatactatgtttttggatcgcccttcgtccgtgcgccttagagtgggggctttcacaaagaagacgggataagggatttgtttgttacaaaaataggcaaaaaagattagagtccgggcgtatttattctcgataggctttacggtaagaatgaaaagttccatagattagtactcttattttatatactgattattttttcttcagtttaggtgtccatatataggcgacggaatcgtgtaacctgatatctttaccatcgaaatataacttataggaatatttatatcctttattccagcaggtgccttccggaatgatgtatttgtaagttcttccattgatagtaaagatcgcctcaacttctttttcccggataggagagtaggtagggactatacggatattttgctcctccgctttcgcgtgtcgtaaagttacggatggatctattgtaagtaaagtggctttatatgccccgggagttcctttgatatttccggttacgatatccattgtcccggtatattgcaaggtattacctcccgcacggttaccgatctgtatggaggttagcttgaatagcccgttgatgtccgaatcttgatatatttcgaatgagagaagtgataatgcataattcatggagagtttcgcgagcggagatttacggttgacctctttttggccttgcgagagcctcccatattcataagaggggggttccgccgcgattggggatattttgatcggtatggaggtaggatctaacggtatttgtactttataaggtgagtaagcgtagatcatgactggtcgattagatctaaggaatacctgcggtgtttgtttccattttaaagaaccttttgatgagcctacagcctttgattttacgtttttataaagagatgcgcctttatataaactgtcttgattaccataggttataaataatcctatttcggacccttcgggcagaatttcggtgaatactgaagaacctgccgtataggaccgggtggtcatttcaagaactgactttcgtgcggttgatttctctttggacatccactgctgattttcatgacatccggtaaagatgattaacaagatcgtaattaataataatttgttcattttgtctaatgttttaatggaacctttcaaacaataaacatttgagccaatatagtttattattctattactattaattattattcctgttataaaatgatatttttatatattatatagtaacgattgttttatcctcttaatacgcaaagtaatctgctttattgtatactataataatcaatatatccaagagatataaagttattattaaacgggtctcgtccttgtaatagtcaaatagaagagtgtttttggcgataagttgagagggaatgataacccttgaatgtaaaagggtatttggacgagacccgttgtttctcttattgagagaatatatagagtcggctgaatgaaaaacacatcgtacgggtagtgaccccgatggtctaattcgccggaatgatagagccaattgttattttcagtgtagttgccggtggcaaacggatcaaagcttgccacggcattacaccttaataaccacaacataaaaaacttacatgatattgccaatcaatccttcgtcgttacccggtaaccagtctgtgatagagacgtctcgcaattgtaacgaccttccgttaaagcttagcttatataaatattttttccctttttcccattgggtgttagcgggtatgtcaaatttgtaggtttctccgttgatcgtgaataaggtctccacgtctccggttccgatcgtgccggaaggtggaattaccatgagccgcataggatcacaatatttctcgttgatgagggtaaccggattcgtcaaggataataccgtggatgcggacgtgctacgggcggtagaaccgatgatatcgcccgtcgtgatatcgagggttccttcgctgactaaagttgttccaccgggcttatttcctacttgaacggaacttataataaaggcacctgtcttgcctttgcttaggttcagctggaaagatataagcgatagggcatgattcatgctgagtaatacaagtggcgaggtactgttgaccgctttttgtccgatcgcatgggttccatacatataatcatcggtctccaatgcgttcggggccagtttaacaggtatctgccgggcgttaaaatttatatcttcttgatatggataatatgcgtatatcgtagcttcattagagtcaaggatcacttccggactctgttgccaccggatttttccattcactctataagcttttacgcttacgtttttataagtggatatgccattgtataaatcgtcgactgtaccggacgtgatttgtagtccgagcatagagccttctttaaattcttgtataaaattggtggattttgtagttaggatacgagtcgttatttggagtggtttttcattccagccgatattctcaagacctccgaagtctttgtcgttggagcaaccccaaaagcttaaaatcatactggtaaagagtactaaatttctcattattttacttatttttgtgtgaaacttctggatgcaaatatcgggtggttaaggggaaagggaggtgcatacggtctaaaacgtcggtgaaatcgtataaaattagatcgttcaaattgtctaaggcgttcatattgttaactgaggggtcaaaaagaacattcggggggcgtattgtttaatagataggaggtagtgttattatgttggataaaattcagtttctactaagcttacagatattaggcttttgtgtttttggtggtattaccctgctactacgggcccgtgagaatagggcaaaacagattttggggtggagtatgttattatgggcgtttttagcggcggtacgagtatcggttaacctgtatttagaggattcaaaagagatatttcatccggatgtgctgattatgggatgtattgtggtagctacattagcttgttacgtgatagaagtgttacgaccttgctatatgaccgttcgccgtttctttatttttaccagtccgatatgggtattgggtatttcttttttgatttaccggctatccggtggaaatattcatcgttataactcttttggcgaggtattcgataccttgaatctggatgtggttataaggcttttgattttatttttcacgcttctgtatatgatcgttcctatttatctgatcttgcgctatagtgagggatttaaggtgtatttaagggaaaatgtatcggacccggaagattatgatctggactggttgaaaaagaccatgctgatcctttcttctatgtatattttttatttggtattgttgtttacggatcgggttagcctatatgtaatcgacaaaacgtttttattggttttatggtactatttcttttataaggccttgttcctaaaggttatccatttggatcacacattcgagagcggatggggattacccgatttggaggaggatacggatgatgatcaaggtagtgaggaacagaaaggcatcatacgccaaaggtatgttgaggaagtacaggcgtggtttgaacgtgaaaagccctatctacgggaagatttacgcttaacggatttacagcggatcttcccgatgagccgctcttatctatcccaattgtttaataaagaattaggttgttccttctcggattacgtaaaccatttcagggtagaggaaagcaaacgtttattggaagccgaacctctggccagtatacaagagatagccgaacgttcgggcttccattctatcagtacgttccgtcgtgcgtttattaagcagacaggggttattccttccgaatacaggagagacgggaacgagtcaatttaaccggtaactgacgaaagcgaatcgcttgctatcgggtgcccaagagtttacgtttatcgtaccttgcccgccgaatagtttgactaaagtcttaggttctccgccctcggctggcataaggcgtaactctacgtttttattggcgaggtgttgtccgggttccagatcaccttttgtataggtgatgaaaacgatttgttttccatccggagagatgtggggaaaccaagaatttcgggtctcatcgaatgtcatctgggtttgttcggaaccatccgccttcatgcgccagacttgcataagcccggtacgtacggagttgaaccagatatattgtccgcaaggtgagtattcggggccatcgtccaaaccttcggctgtcgtaagacgtttttcttctccgcctagggcaggaatgacgtaaacatcaaaattaccgtttctctcggcgcaataagcgagttgttttccgtcggggctccacccgtgtaggtagctaggaccgagtggggtaatcaatcggggaacacctccttcgaaaggcagggtatagatacgcgaccggccatcttctttcgttccgttactgatcgctatttgcttcccatccgcggagatcacatggtcgttgttgcaacgggtcgcgtagtcgctattgattaattgcggctctcccggagattccggagagagcttatataattttcctccactattatatacaagccaattaccatccggagtccagttaggtgcctcgatcaaaaaagggaattccttgacaacggaacgttgcccggtcgtaatgtccatcacttccagcacactagtcacattctttttttgggcatgcgtacaaaaaacagcgatacacatacaaagtacagaattgagaaaacgtttcatatacatatagatttaaaggatataagaaaaccgggtaaaattagctttacgctattttacccggtttcaaagatataatttatttcgattactccttatacattgaaacggaaatgcatgatatctccatcttgcacaacatattccttaccttcaacgctcatctttccggcctctttaacagcagcctcggagccataagcgatataatcctcgtacttgatcacctcggcacggataaatcctttttcgaagtccgtatggataacaccggcgcattgaggagctttccagcctttatggaacgtccacgcacgacattcgtccgatccggcggtcaagaaggtttgcagattcaataatttgtaagccgatttaatcaaacggcttacgccagactcttccaatccgatctcttgtaagaacatctggcgttcctcataggtatcgaactcagcgatctcgctctcgatcttagcggcgactactagaatctgggcatcctcgtctttaaccgcctcgcgtacggcatctacatatttattgccgtttacggcgctagcctcatccacgttacaaacatacatgacaggtttatccgtcagcaagaataaatcgtgggcaatgcgttcctcgtctttcgtatcaaaagaaacggtacgtgcgctttttccttgttctaaagcctctttgtatttacaaagtacctcgtaagcgatcttggcttgcttatcacctccggtttgcgcttgtttttgcaccttggcgatacggctgtctatcgtttccaaatccttgatctgaagctcatagtcaatgatctccttatcacggaccgggtctacacgtccgtccacgtgcacgatattatcgtcgtcgaagcaacgcaatacgtgcaagatagcgtctgtctcacggatattagccaagaacttattgcctaatccctcgcctttactcgctcctttcaccaatccggcgatatccacgatctctacggtggtggggatcactcgctgcggatgttcgatttccgctagtttattcagtcgctcgtcgggtacggtgatcacgcctacattcggttcgatcgtacagaacggaaagttcgctgattgtgccttcgcgttggataggcaattgaaaagggtagactttcctacgttcggaagtcccacaatgccacattgtaatgccatattattatcgtattttttattatcaatctgttatatagtcgctccaagcgacttgttttgagttcgcaaagataatcaattttaggctgatacggttattttcttaggctttctcttcatgcttaaccggttgcctcatcgattgtttgtttaataatgttttaacgagtttgttcataggcttctttattaatgttattttttacttaggttgttctctcatatttccggtaaaagaaagtcaataacaagaatccgataaaagcgaatccggaacctatcaaggccggatatttataaccaaggccgacctccaatggtaacccaccacaataagctccgatagcatttcctaaattgaacgcaacttgtacgctggcggctcccagcatctctccacctttggagtaacggatcaataatacttgttgagggcttgagacggcgaataatcccgccgtacacagacacatcagcaagacatttaaccaagatatttgtgccaagaagaagacgagcagtagggctacgcaaatcatgccttgcgctatggccgctacccgtccgggcatatatttatcggataggcggccactgatcaagttgcccgctaccataccgaaacctgccaataccattagaacagtaaggctttcggccgagaagccggatacttgtgtcaatagcgggctgatatagctataccagcaaaatacacctccgttacctagcattgtcgcccctaggattaaccatggcgcttgagtcttaagaaaacgaaattgtcctttaaagccagtatccggaaggttctctaccataggtacccatctccagatgtaatataagatggctatgccccagcaaccaaccagtaagaaagtcagacgccacgagagcatggtgctgagggccgtccccaacgggacaccgaataggttggcgatcgtcatccccgctatcatgatagagacagcctcggagcctcttcctttatcagcaagcttttcggctacgatggagccaacaccgaagtaagctccgtgaggcaatccagagatgaagcgggctatcatcaatacccagtaattagacgctaatgcggcgcataaattaccgatcatcataatccctactaaaacaagcaaaatgtgttttaatggatatctacgggcgataatcaacatgggagcgcctacgcaaacccctagtgcataagctgagatcagatgcccggctgtagcaatgctgatgtgtaaatctttcgcgatgtcgggtaggatacccatcattacgaactcggcaatccccagcccaagggtaccgaaagctaaagcgatcaaactttttttcataacctaaaatgctcaacaatcttttcgagcgcaaatatagtgtatagtatacattattatttgcttttcggaatgtttttaggggaaagttttgcgtttcgtgatgggctgttagggtcttaaaaaaacatgtacgtctttcaagaaaaagtcgtacgtgttttcaggaaaacacgtacatgtttttttaaggggaattccggcattattttaatgcgcctccaaccagttctctccctcgccgcaatcggcgatcaaggggacttgtagtttcatgacgttttccatttcctccagcacgattttctttacctcctcggcttcctctttgtagacattgaagtttaactcatcgtgtacttggaggatcatcttgcttttcaatccctcttcctcaaagcgttcgtaaatgcgtaccatcgctagtttgatgatatcggcggcgctcccttggataggggcattgatcgcgtttcgctcggcataaccgcgtacgacggcgttgtgtgagttgatatccggaaggaaacgcttgcgcttgaaaatggtctctacgtatcctttttccttggctaccttgatgctctcctccatgtattccttgatgcgggggtaggtgctgaaataaccgtctatcagttccttggactcagaacgagggatgcccagacgctcggcgagcccgaagacggagatgccgtaaatgataccgaagttggcggttttcgccttccggcgcatatcgctggttacttcttctaccgggattccgtagatcttggcggctgtggcggcgtggatatccgctccgctttggaaagcctcgatcatatgcgggtcaccgctcaggtgggccatgatacgaagctcgatctgggagtagtcggccgagaagaagaggcaatccgtattgtccgggataaatgccttacggatctcacggcccagatcgtcccgtaccggaatgttttgcaggttcggattggtagagctgaggcgtccggtagatgttaccgcttggttgaaagaggtatgtatctttccggtctgcggattgatcaactcgggtagagcgtcgatataggtacttaataactttttaagtccgcggtattcaagaagcttgccgatgatgggatgcttgttgcgaagtttctccaatacatcctcgctggtactgtaaccgcctgttttggtcttcttcgctttctcgtccagcttcaagcggtcgaaaaggatttcgccgacctgtttcgtggagttgatgttgaattccgtgccggccagctcgtaaacctcttgctccagtttgttcatggaggcggtaagttcgcccgaagattgcttaagcgctactgtatccagcgtgacgccggtagcctccatttccactaatacatatattaatggcatctcgatcgtggtgaagagggattccagtccttctttcttcaactcgggcgcgaaataattctttagcttgagcgtgacgtctgcgtcctcggcggcgtattcggcgatttgctccacgggtacgtttcgcatcgataactggttctttccttttgggccgatcagttcctcgatgtggacggtctggtacttgaggtaggtctccgctaggtaatccattccgtgccgtaattccggattcagcaggtaatgggcgatcatcgtatcgaacagaggaccggctacctttacgttgtatttacgaagtaccaaaatatcgaatttgatgttttgcccgatctttaatgatttcggattttgcagggcaggggagaagcgttccactactttcgccgcctctactgagttggcgggaacagggacataccaagcctcgttttctttcacggcgaacgacattccgaccaatccggctttcaagggatcgatgccatcggtttccgtgtcaaaagcgaaaaattcttgacccaataaaaagcgggctaaatcggcttgtttttcctctgtatcagttaaataatagttatggggggtggactttaagtccgtgagaatcgattttttgggctcttccgtactctcgggcgtaaaaatcgcgaacaaatcgccttgaacgggacctttcggagcggctttgaccggctcagaacttagcttgttaataaatgttctaaattccaattctgtgtaaatctcagtcaggcgctcttcgtttggcttttcacgaacgcaacgggcggcatcgaactcgatagggacatccgtcttgatcgtcgccaagaatttggagaaacggatttgctcggcgttctcctccaccttcttcttttgtgcgcctttcaacttatcagtgttcgctaacaggttctcgatacttccgaattcggtcagtagtttttgagcggtcttctcgccgacacccggacagccggggatattatcggaagcgtcgcccatcagtcccagcaagtcgatcacttgctccgtactcgtgaggccgtacttgtttaagacctcgggcacgcccatgatctcgtaatcgcctccgaatttcggacgatacataaatatatgttcggacaccaattggccgtaatctttatccggcgtcatcatgtacacctcgaagccttccttctccgcctgtttggatacggtgccgatcacatcgtccgcctcgtagcggggtacttccagaatcggaatattgtaagcctctatgatttctttaatgatagggacggattgacggatcacttccggcgtctcttcccgttgtgccttgtattgctcgaaggcctcatggcggaaggtcggtcccttcgggtcaaaggccaccgctatatgagtcgggttctcacgttttaatacatcctccagactgttaataaaaccgaaaatggcggaggtattcacacccttggagttgatacgcggattcttgatgaaggcgtaataggagcgataaattaacgcatacgcatctataaggaataacttcattacttttaacacgttttagtgggacaaaatctgggtaaatgtacgaaaaaactcgcttactcgatagtttttgttacttttgcgaatctttgcatggaattatggatgaaagaaggaaaatagaagaaccggtttccgctgaatttgaacgtttcaataaggatttcgaggcatctctacgcagcgagacgacccggttacaatcggctatcgacgttatactgaattctaccgggaagcatgtgcgtccgttattggtgctccttaccgccaaggtctgtggacaggttacggataacacgatcaattccgctgttttgctggagcttttgcataccgccacgttgattcacgatgacgtgatcgatgagacgaagcaacgtcgtggcgttccctcattgaacgctatcttcgataaccgtatttccgtgttggtaggtgattatgtgctttctaccgctttgatccgttccatacaaaccggcgatttgcggattgtcgggattatctctaatttaggcagagacttgtccgaaggtgagatcaagcaattggagaccgccgaggagagtattttagacgagaattgttatctgcaagttatcaagaagaagacggctaccttgctttccgcttgcacggagattggggctatttcatcgggcgcctctgcggaggtgatcgctctttgccgtgagtttggcgagtatctggggtattgcttccagatcaaggatgatatctttgattatttcaaggaggcgaatatcggtaagccgacgggaaatgacattcgtgagggtaaggttacgcttccattattatatgccttgcggcagggtagggaagaggaggccgcccgttatttggatatgattttacggaaagatttcgcggcggagaatgtcgattccttgatcgagttcgccaaggcgaatggtggaatcgaatatgccgaggcccgcatgaaggaatatcatgataaggcggtcgatgttcttttgagattaccagaatccggggcacggacatccttgatccagctggccgattatatcatgactcgctccaaatagaaattcctttatctattagttgtagagagatggctcttgttagtaaaaaagtaagtatgcttcaatagccaatgaagttaacttgcttgacgaagtcagttaacttcgatgtcaaggtaagttaactgactttgagagtgcttaccggacacaggattctaagtcatctgcgcccggtttattagaatggactatttcccgagtcgtttttctatatcaccgaccagactgctcgctcctatacggaacaaatctttgttaagccattcatcgcctagtatctcctttacgatcgtataatatcgaactgcgtcttccgccgtgcgtacgcctccggagatcttgatgccaaccttgtttccggtgatggaatggtaggttttgatggccttgcacatggtataggcggcctcgaaagtggctcccgggtatcctttacccgtggaggtcttgatgaagtccgcaccggaatacatggctaggatggatgctttttggatgttctccgctgtgactaaagctccggtctctaggattacctttaaatgggcgtggcgacagctctctttgatctcttgtaattcttccgtcagttcctcgaaattgtcttccatgaaatagcctaggttcatgacaacgtcgatttcatcggctccttgcatgacggccatggccgtttcggcgatcttgacttccgtaaatgtctgtgaggaaggaaaacctccggcaaccgacgcgatcttaacctcttgtgcagtaagtgcctgcttaaccgtttccacgaataggggatagacgcaaatagcggctacgttcgggacatccggacgagttccctcgaaatcatttaccgtgtctaccatcttccagatactttctttggtatccagactggttaatgaggtcaagtcgatgcaaccatgaatcgttttcaatacttccggtgtaaagttttcttggaaatgtttctctaaaagagcgtttacagtctcagtggcctgggtatccggcagggccggctcaaacttattgaaagcttcatgataacggtctatctgtacggaatttgattcgtgttcatgttcatgatgatgatcatgtccacattcgcaatcgtgatgatgtgccatatgcttatagtttttgattgtttatatgtcgttctttatctcggtctgttttcttttggagattcttctcgaaagcggcggtaaggtctactccggtctggttggccagacagagcaatacccataacacatccgccatttcatcgcctaaatcccggtgtttgtcactttccttgaaagactgctcaccgtaggtacgtgccatgatccgggctagctcgcccacttcctcggtgaggatggtcatattggtaagctcattgaaataacggaccccataggtcttgatccaagagtctaccatttgctgggcttgttgtaaggttatatctgccatacttattctttattttgagagtcgataataatagtaaccggcccgtcgtttaaaagttcaattttcatatcagctccgaatgttccggtttgtacaggttttccgagttgaagccctacctcttcgcaaaaagctttatacatcggaatggcgatatccggtttagacgcttttaagtaggaggggcggttcccttttttcgtagaggcgtgtaaggtaaattggctgacaaccatgatctcgcctcccgcttcgataaccgagcggttcatgaccccgttttcatcgtcaaatatgcgtaggttggtgatcttttttgccaaccattcaatgtcttcttgcgtatccttgtcctcgataccgactaataccaatagcccctttccaattttggacttaagctgtccgtctatcgtgacggaagcgtgctgcacacgttgtgtaactgttctcatcttgttcgcttttgttctatttttgttcgctttctgttcgctttccatccagtccctcttgtagtgccttggctttcgcctcgccaatcacggatttcagttcctcgaagcttgcttccttgattcgttttacgcttttaaagtgacgtaaaagtaatacttttgtcttttcaccgatacccttaatggtgtctaattcggattttgtctgggtcttacttcgtttatccttgtggaaagtgatggcgaaacggtgtacctcgtcttgtatccgggtaagcagatggaatagcggactgtccaaacgcatgccaacggttacgggtgggaacccgaataataactccgaggtccggtgcttaccatctttcgctagtccggcgattggaatggacaagcctaattcatcttctactactgagcgaaccacttccatttgcccctttccaccgtctgttataatcaagtcgggtaggggagatcgctcctcgattgcccgcccgtaacgcctacggacaacttctttcatagaggcgtaatcatccggaccgactacggtctttatattgtatttacgatactcctgcttggacggttttcccatcttgaataccacgcaagccgctaccgcatcgcttccctgtatgtttgaattatcgaaacattcgatatgagcaggcaatttctccagatgcaaggcctcttggatctctttcaagatacgggtattccgttgttccggattcaacttttccgcttgcttcaagcggtcaaccttaaactgcttgacgttcatctcggataaatcgagcagtttctttttatcccctctttggggaatggtgaaagtgacattctctagctgcatgtccagcttgaagggtacgataatctcccgggcggtgcttttaaaacgattccgcatctcgataatgcctaggcttaacaattcctccttgctttcgtccagtcgttttttatactcgaatgtataggcttgtacgatcgccccgtttccgatatgcataaagttcacataagcggaatggtcattctctatgatcgtgaatacatctatattatgtagcatcggggttacgaccgtagatttagaacggtagttctcgatgacttcgtatttttccttgatcttttgcgcttcctcaaacttgagctcggcagcgagcgattgcatctcctcatagaggtgtttgctgatttgcgagatgttgcctcgcagaatctctttgatctcggaaatattttgctggtattcttccaatgattgcaagccttcacaaggccctttacaacgcttgatatggtattccagacaaaccttatagcgtccttgtgcgatggattcgggagtgaggggatatttacaagtgcgtaaagggtaaagttcctttagcatttgtagcatcactttcgccgtgaacaaagagggataaggaccgtaatattgtgatccgtcccgaacgatgttccgggtttggaaaacccggggaaagtactcgttctttaccacgatggaagggtaggttttgtcgtccttcaataatacgttatagcggggacgatactgtttgatgaggttgttttccagtagtaacgcgtcttcttccgtatcgacgactatatatttgatatcccggatttgcttgactaacacacgggtcttattgctgtcatgtaccttgttgaaataagaggatacccgtcgttttaggttcttcgccttgccgacgtatataatcgttccgttttcatcgaaatactggtagcatcccggcttttccggaatgaccgataggatcgtcttgatatgttcgtctttatcggctatcatacgaatagggaagtaaattggaatgtctcgctattgaacaaacctttgttgctaagttttaaggatgggatcgccagcaatcccataaaagaaagcgtcatttgtaatgaatccatcggggattttaatcgcttgatcttttcctcgatctcttcgtaacggcggctcgtctcttccaatgattcgtcgctcatcaatcccgctaccggcaaggacaggagagtgacttcgtccatgcagctcacggcgattcctcctttcgcttttatgaccacattgatcgcttgcataagctcgaaatcggttacgcctatagcgatgatgttatggctatcgtgggagatactttgagcgatggcaccgagcttgagccctgttccttttataaaggtaatagcgggaggagccgtttgatagcgatttagaataacgagttttaaaatgtctcgttctgtatctgattctacaaatccatcgaatgtatgtacaggatatagttcttctttcgtgattaattcgctgtcttcgcaaacaatgacacgcatctgttcccctttcgcttttaccgctagcttttctaatgtgatcggtttcgtgtggaaattattacgatgtataggcttttggagtggaagcgtgcatttctctccatcgtatacacaggttccttgtatataggttgcctgtatggttagatcctttaaattgtttacttggataaaatcggcggtgtctccctctcgtaagaaacctgcggggattttatagtgcatggccggattataggaagcggcccgtaatacatcatatagatcatatcctaaatccagcgatttttttaccatcctatttatgtgtcctttgtttaaaaacgaaggatgtgcgtcatccgtacagaacatgatttgttcgggatactctttcaatagcggatgaagtgcgtcaaagtttttcgccgcgcttccttcccgaataagaacatgcatcccaagctcacatttctcacggcctttttctagatagatggtttcatgatcggtggaaataccagactcgatatatgcctttagcttgggacctgtcgctaggggataatgtccgtctatgggtttacccgcttgtttcgcggcttctattttgcgcataacttccggatctttatttaagactccggggtaattcatcatctctgccaagaagtgtagatcctctcgttccaacaaacgagcggttttgtctgcgtctatgatcgcaccggaggtttccataatcgtagccggtacgcaagatgggacaccgaaccatgtgtagaaaggaatccctttcgcattgtcgagcatatattcgactccttcggtacccattacattcgctatctcatgagggtccgccacggcaccgatactgccatggcgtacggctgcgtgaatgaatgccgtaggggttaccatgctactctctatatggacatgtgcgtcaataaagccggggaggaggtaatatccctcatcttgtccggtaggggttacctttccgatatgcccgtttaggattgaaatctctgccccgaaggtgcgcctgttgattatatctaccagatttcctcgtataaccagtgttttagcttcattcatttgaatatctcctttaatatgtttcacgtggaacatttcgtgttttatcttccgagtagtaccaaaaggatgttgatgtcgctaggggaaatacccgggatgcggctcgcttgagcgatcgtgtcgggatctatccgggtcaatttctggcgggcttccgtagataaagactggatcgagttgtaatcgaatttacccttgatccggatattctctaaacggtttatcttatccgctatgatttgttctcgcttgatgtagccgctatacttaatcaatatctcagcggcctcgatgatctcttccttacgggaggccgggactttgtccagctccgcacgaagggccggaactagatctgcgaggttttccaatgtagtctgcggacggagtacgacatcgaataatttgcaaccatgggataggggggctgtgcccagtttttccaaaccgctatttatatattgaggctttacggagtaggtctccgcgaaacggatgatagcgtcacggctctcttttttctctcgcagtaaatcgtagcggtcttgtttggccaatcccatttggtaggatttctcggtgagtcgcatatctgcgtcgtcttggcgcagtaagatgcggtactccgcacgagaggtaaacatacggtaaggctcgtctacgccttttgttaccaaatcatcgataaggacaccgatataagcctcatcccttccgaggataaaaggttgtccgccgtggcaattgatgtgggcgttgatacccgctaccaaaccttgtccgccggcttcctcgtatccggtagtcccgttgatctgtccggcgaagaaaagatttcggatttgtttggtctccaaattgtgtcttagctgagtcgggtcgaagaaatcgtattcaatcgcatatccgggacgatagatttgcacgtcacggaaagcggggatcgcttggagcgcacgaagctggatatccaagggtagggaagaggagaagccatttaggtagtattcctgcgtggtctcgccttccggctctaggaatagttgatgctgcgtcttgtcggcgaacgtcacgattttcgtttcgatactaggacaataacggggaccgatacttttgatctgtccattataaagaggagagtcggggagaccttcccgtaatatatcgtggcaagcctcgttcgtaaaggtagtccagcaactcaattgttttaatttacgatgactggtatccatgtaggagaacttatggaaatcgttctcccccggttgttcctccatttcatcgaagtgaacgctccggccatcgatacggaccggtgttccggttttcatacgatctgtttggatacctaaagagatgagttgctcggtaagtccggtcgccgcaggctcggcgatacgtccgccccgtatctgggttcttccgatatgaagcaggccgtttaggaaggtcccgttcgtaagcaccaccgctccggcacggaatacgacattcattcccgtacgaacgccgcagacttgtccatgctcgataatcagttcttgaaccatgtcctgccagatggatagattcggcatattctccagcatgccccgccagcaatcgataaaacgggcacggtcgctttgggcacgcgggctccacatggccggtcctttgctacggtttaacatacggaattggatagcggtctggtcggtcacgattcccatatatccgcctagcgcgtcgatctctcgtacgatctgtcctttggcgattcccccgactgccgggttacaactcatctgggcgatcttgttcatgtccatcgtgatcaaaagcgtctttgatcctagattcgccgcggcggcggcggcttcacagccggcatgtcctgcgcctactactattacgtcgtaattgaaagtcatttttattcccttttattttacgcgaagatagtgagtgttcgtgaaagaattcgtttatatttgtataataaatacatacattgttttcaggtttaacgaactaaagatttaagctgctatgaattctattcaatgccgtatccttgttttccttgttttactgacctcttgcttcagtccggtttgtgggaaagataagaaacctcgtcaagcgatcgagaagttatcgatcgatggtccctatctattgaaagcggatgatggtagtatgcgtgcgatatctgtagatgggaaaagccggttattggataagcattataaaagtatacctaccaccttttcattcgaggtgttttccgataacggggagagattgtttccggtaaccatacactccgtctctcgtccggaatggaaagatgtgcaacctgagaagacgtttgttctttcagatccacatgcgaactggtcttgtttcgcctccctgttaaaggcgggaaaagtgatcgatgcggactataattggatttttgggactaaccaattggtgataatcggtgacgtctttgaccggggcgtggatgtactccctatctattggttgatctacaaattggagaaagaagcggaagatgccggtggaaaagtgactttcttaatcggaaatcatgagaccatggttctgggaaatgatttgcgatatacgaagaagaaatatactcaattggcggatactttaggaatgacctatccggagctttggcagaaaagcgagttgggacattggttgaaaactcgtaactctatacaagtggtcggagataacctgtttgtccatgctgggttgagcaaggagtttttagaccggaattacgatatccctaccgtgaatgagatcgtgagcgatggtctcttcttaacgaaaaaagaacgtaatgcagataaaggctccgatctttcttttatgttcgctacgtatggaccgatctggtatcggggtatggtacgtagcgcagataagtatcatccgctagaccgggatgatttgcggaaaatattagagaaatataatgtgaaccgcatctttgtaggtcataccattttcgatgatatcacgactttctatcattataaagtgattgccgtgaatgttgataatcaagaaaacaaggagaaggaacgaggccgtggtgtcatgatcgagaaagacggttctatgtttgtcgtatatgattccggaaaacaagagccgttattaaccgagtaatatttggtgcttgagctgtcacgactgctaccatcatggtagaggaagaagtgcctcccctaatgtgaactaatgagatagggagtgcaacttttatgtatcttaaatcatctataaatatagatatgttttaaatgtaggagttatgaaaaaagttgtattactgtttatcttgtttgttttctctttgtcgcaagctgatgctcaagagttccattttattcctaggattggcttgaatttggcaaatacttatcccgaaagttttgcggacatgcgtccggggttaaatattggtgtggcggaggaaatacgttttagcaaactgtttgctttagaaccgggtgtttattattctatgcaaggttatcaaaaagaaaacgctaaaggcgagacagcccggctaaaggcggattatttaaatattcctatttacgctaaattttatttgtatcggggattccatcttttcgcgggcccacaagttggctttaatataagggcgaaagcttcgaattatattttcgtctcgggtcctactccggtgcaccagagcgagtacgatttttccggtgataaaaaagaagagatccgaaattgtgatttctccgtttcaatggggcttggctatacctttgacatgggattagttatctccgccaattataatttaggatgtactcatttctttaaggagccggaatactcattcggtggaagcaatcattttaggggaaaagatcataatggggttattcaattcaatctaggatggcgtttctgatctccagtaaatcgtgaattaagagagatcgcttgttcctcgttcagccttgcggcatggctacacaggcaatggactgctttcgggcattgctcgtccgtggcgtagcaatacgtgtaatcgtaaggtatgtcttctgttttcatgttgtctgtattatttttatttatttcaacaatagtctgctctcaaccgcctctaatatcttcatttgctggatcgctatttgattaagctttattagtcgttcacgctgggtaagtccttcatcaataaatacagcattcaggctttccatattcgataaacagataagttcattaatagtcgcatagtcacgaatgttaccttttaattcgggattggcttcccgccattgtttagcggttgtgccgaatagagcgacattaagaatatcggcttcgtttgcgtatataaagcttacctgttgcggggttaactctatggggatgagattatgcttgatagcgtcggtatggatgtgatagtttattttggagagttctcgtttggcagtccagccgatttgtttctgttcctcttcttttaggcgttgaaactctttaacgatatataattcaaattcaacagagatccaacttgcgaatttgaaagctatatccttatgagcaaaggtgcctccatatcttccggatttggagataataccaattgccgctgttgtatttatccatttttgtggagaaagggtaaaagcatttaaccctgcttcctttttaaacccctcgaattcgaggggtttaaaattaggattatataaactttcccatatacctaaatattcaatggtattacgattacgcatccaattgccaattactgctgtcggatcatcgcttttgtactttgcgatgtcggtaagtgagatatagtcattcttatttatagatatgatcatgacacttgtattttggactgtgattttctccataattttcttcagataagatttgtagtataaatttgtttctggttaacatctctttaccgacattcctccggcaagatcgctaacgctctgttctcgttctcctccatgatctcccgctcgccggggcctttgtcgttgataccgcaaaggtgcaggatgccgtggatgatggtacggtggagttcctcgttataatccgtgtggaatgtctcggcgtttgtcctgaccgtatcgaggctgatgaacaggtcacccgagatcttatttccttccgtataatcaaaggtgatgatatccgtgtaataatcgtgttggagatattggcggtttacctccaagatcttctcgtccgagcagaagatgtaactgatatcgcctgtcttcttcccgtaggtctcggccaccgccttgatccatccgctgaccgcttttttcttgattgccgggagctggatatcctcggcgtaatatgctattgccataaggtctatttatcgtattgaaatttcgttacaaatgtaatcattcgattttaaatagattcatttcaaatctattgattgtatagaatgttaaaagaacaggtaagccatcgctatcgccgctatcgccccggccagatccgctaacaaggcgcattgcaccgtatagcgggtattacggatacctacgctaccgtagtaaagagcaactacatagaatgtcgtatcgcaagagccctgaacgatggatgacaggcgaccgacgaaagagtccgctccatacgtgttcatggcgtccagcatcatgcccctagccccgctcccgcttaacggtttcatcaacatggtaggtagcgcttccacgaaatccgtgttgagccctatcgaagcaatgccgaaacgaacgccttgtatgatgaaatccatcgctccggaagcccggaagacaccgatacctactaggatagctaccagataaggaataatcgttatagcagtctggaaaccttctttcgccccttctataaaagcatcatatacattgatctttttacgcatgccgctgatgataaatccgcagataatggtaaaaagaagcgtgttggcgaataaagtcgaatacaaggaaacttgctcctgttccatcgagttaaatagccataccaggcctccgataaataatcccagtcccccgaaaaacaggattaggttccgttggaggatattgatcttctgccgtacgcaaaccgctaaaatagcgactaaggttgatgtgaatgtagcgagcatgatcggcaggaatacgtctgatggattcgccgctcctaactgcgcccggtacatcatgatggtgatcgggatcaaggtcagtcccgaggcattgatgcataagaacatcaccatggagttgctggcggattctttattcgggtttaattcctgtaactgttgcatggctttcaatcccattggcgtggcggcattatccagtcccagtaaatttgccgataggttcatgaagatagaaccggtcacgggatggtctcttgggatatccggaaaaagcttgctgaatacgggagccgccaatcgtgcgaacgcttgtatcaccccccccttctcgccgatcttcatgatgcccagccaaagcgacaaaatccccgttaatcctaacgaaatctcgaaacccgtcttggccgaggcgaaagaagcgttgataatctcggtaaaaacagcggtatccccacctatgaccaatttaccgatagccactacaaaagcgattaagaaaaaagcgatccaaatatagtttagtaccataataaatatatattggtcacaaatttaggaattaattgccaattgatttgtatttttgctttttgaataacaaatagatccaagatgaagatattagtgacatacgacatgttccgcaagggatttaccgagttggaaagtaagtacgaggtaacctttcccgaaggaagagattttacgtatgaggaggttttcgagatgataccggagtacgatgtgctctgctccatgttcgatttcccggtaaacaaagagttgatcgaccatgcgtcgaaattgcggctgatcgctaactacgccgttggttataataatatcgatgtggcctacgccctcgagaaaggtttgacggtggcgaatacgcctgatcctgtcacggcccctaccgccaatatcgctttaggcttgatgctggataccgcccggcgtatcacggaatgtgatcgtaagctgcgtacgcttggtaaggacatgaaggtcggtgtactggagaacctcggtatgccggttaccggacagaccttgggcattatcggtatgggacgtatcggcaaggccttggcgaaacgggcgaatgctttgggcatggatgtgatctaccacaatcgccgtcagctttgcatcgaggacgagaccaaattgaatgttacctacgtctccaaggaagagcttctggcgaaagccgatttcgtatccttgaacgccccttatacccccgatacctatcatatcctcggcgaggaagagttcaagcagatgaagccttccgccatcctgatcaacacggcccgtggcccgttggtggatgagcatgccttggtaaaagccttgcgagaaggtacgattcatggtgccggtttggatgtattcgagtttggagactatcctctccccgagttattggaaatggacaacgtggtattaacccctcatatcggcacccagacgatggaaacccgtatcattatggcacgcacggtatgcaacaacgtgatcgggttcttggagggcaatcgtcccgtatcacgggtactccggccatgacggcggcgtttatcctatccgagctacagtcggtcggtacacccgagaaggcggttcatttgagccgctttttcaagactggtcccggtcaatatggcgagggcgatcagtttctcggagtggttgtcccgcaaacccgcagcatagcgaaggctaataaggcgactcctttcgatgagctgcagctgttgctggatagtccgtggcatgaggcacgtctatgtgccttgctgattttggtctatcgtttccaggatcggaaagcgatgccggaagagcgggaagccatcttccgattctatctgaagaatatgcggcgttgcaataactgggatttggtagatttgacctgtcgggatatcgtcggcgaatatttggtggacaaagatcgttccctcctctaccgtttggcggaaagcgagaatttatgggaacaacggatctcgatcgtctctacgtgggcatttatccgtcggaatgattttggggataccttggagttatccgaacggttgatcggtcataaacacgatttgatgcataaggcggttgggtggatgctgcgtgaggtcggcaaaaaggagcggcagacgcttaccgatttcttggaacgcaacgctactcgtcttcctcgtacggcgcttcgttacgctatcgagcattatccggaacccgagcggcaatattttctaaagaagaaataacatggatacaaagaccatctctttacttcgtgaatgggcgaaaacgtacaatacggaatcgtttatcaaggatgatccggttcgattcccccatcggtttacggagaaacgggatattgagatatcggctttcctgacggcgtggatctcttacggtcgcagggcgcatattctccaaaaagcggaagagctacaccggctgatgggcgaaagtccttacgagtttatccgtaccggagagacttctttcgctcccctacggaaccgcccggttcgcaggcgggataccttttaccgtttttatacctatcatgatctgcatctcctttgttgtcgcctaaaggatatatacgatacctacgactgtatggaagacgctatggccgccgccggtccttgcgaagatcctatcttgcggttgcaacaactttttgctgatctcaatggcattccggtcttgcacgggacttccgcttgtaagcgtctggcgatgttcttgcgttggatggtgcgtacggatggtatcgtcgatctcggtatctggagaacagccgtgcatccccgccaattaatcatcccgttggatacgcatgtgcaccagatctccttgcgcttgggcttgacaggccaaaaaaccgctacccttcgtacggcccgtgagataacggacgcattggcgaaagtcttccccgatgatccttgtctgggggatttcgccttatttggctacgatataaatcaagaataaaaagatatggaagaaaagaagataaataacatctcgtctgtttgtgtgtattgcgcgtccagcacgaagattcccccgatttattttgacgccgccaaggaattggggtgtcttttgggagagcgaaaactacgggtagtcaatggtgccgggaatatcggtttgatgtgcactgtctccgacgctgcgttagcggctggtggaacggtaacgggcgttatcccccattttatggtggagcaggattggtatcataaaggcttgaccgagttgattgaggtcgagacgatgcacgaacgtaaacagctcatggcaaacctctcggatgcggtgatcgcccttcccggtggatgcggtacattagaggaacttctggagatcatcacttggaaacaactcggtctctacctcaatccgatcgtaatcctcaatattaatcattactatgatcccttgttggaacttttgaggaacgccatgaacgagaatttcatgcgtccccagcacgccaagatgtgggcggtagccgacacgccggaagaagctatccgtctcatctacgccgagccgaaatgggacgcaagccttcggaagatcgcggcgatttaaatcttaaaaatgaatatgataatgaaaaaactaggtttattaatgatgttgttgctcctgtcaaggatcgctttgttctgccaggcacagacggcgggtatcgaggagaaggaagtgcttaggaatgaagatgtgattttccatcagattgatgagcatacatggtttggaacaggtcatttaatggcgaacgagagcctgtatctggtcgagggagaaacgaaagcgatcttgattgatgcaggaacaaagatcaaggatttggataagctagtggcttccatcacggacaagccggttacgctggtcgccacgcatgtgcatccggaccatacaggctcggctatcgattatttcccggagatttatatcaatccggctgatacgataggtataccggaatttatgccgaattataaaggcaaggtctgtttcctcacagatggcgaaattctagatttgggtgggcgtaccctcgaagttgtctttactcccgggcatactcccggatcgaccacttttgtggataaggatgccgcttatggttttagcggcgattcgttcggctccggtaatctattgctgggagttgacttctctacgctaatatctacttgtaagaagatgagtgcggtgatcgagaaatatgatatcaaatacctctaccccggacattatttcggaatgaacaaggaaacccctcaacgtgtaaaagacatgatcacgatgagcgaggatatcctgtccggcaaagcacaaggcgagcctaacccacaaggtatgttggggctagaccgagtatacacgaagtatggggttcgtataaattataagaaggagagtatgaaataaatatgagaacaagtagatttagcatatattaatcttaatatatacagaggttcaagctcctatgatagaaatacccccaaagttgtctatttaactctaggggtattttattttggaatattaattattcaaaatccgaacagtcatattcattttgattatgataatctatgaaacatgtatatttcatatttataggaggtcgtacttgataaaatttacctgctcttaggtaaaaatggtcattagtccaatttcctcgatctaaatatgtagtgcctattgtttctgtcatgcgatgaccatatgcaattggatactctatgccttttgtttgattatgaaaagtgaggttttgatctagttttacctctcttgctttactaacactataattaggtccaacatattgttgtaatataaggcgatttatattaaatccaatatagttttgggctatcgttttgattgaacaggctttatctgcataaaaccttaaataaacattagcatcagtataccatgatttaacatttccacctgatacatctttggttatatcatattcaagtcttgcataaacaggatcactgtctatatctattttgaaattaatgcgatatggagaatcgtcactatagtttgcaaaagaacaaaaaattggtttacctggtgaggatgctgaaaactctcctccctctgtaatataatttgtgaattctttaatacctcctatagttttaactcctgtgacccctgatcctcctgctatgaaaactttcatttctgcgctattgaaaaaggcttcttgctcctttgtgagtgtattattcttgttaataaatagcgaattaaaagtttctttcactaatttgttagctttttcataatcgtaatttgtttctagtgtgagaatacctattcttccataggcaatagagctaacgtatacaggtgagtatcctcctggcatagttcctgaaattagaccattactaggaatatccatgtctaatgtgaaatatttctgaataaattttatgcaaagtccagagctgcgtatgattctatatttattttgatattgcgcagaagaagttccccaaaacaataatcctgtattttcattagagccaaaagtcatttttaattcatcatatgatacaaatttttgaacatcaaaacttaatgttgcactttgttttcctatattattttgttgcattagatccatgacaaattgtctgatattcaataaagaaggctcttttatagttcctcctacttttttagcaggaaaagagacagagacatggaccggattgttttttacaggtattggagtaaatcgtgtctctgcaatgctagatgcttccaatattgatcccgggtatatgtatctattcatattgtctggtattaccatttcatccgatcgggctgtaattgttcttccaaatccatttgcccatgcaatatcggagataatatttacactttttgtaatcgctttttcttctaaaatatttttagcaagaaaaggtatatgattatgagctgttattgtgacagtgggttcaggatatttctctaagattcctttagtcttattatgaataaggctatcatcatttgaacatgataatcctccaaatatgatgattgtaaataaaaatattgatgtaattctcatagtataattatttataaggtatgtttactctgaattttgcgtagaatggagaatcatcacttaagtagcttgctgaataaaatataggatctccaggaacatccttactaaattctcctccagctataataaattccttaaatccattaattccatccactgttttcacagaatagctaccatcaccacttatgattgcaatttttaagtctgcttcactaattattttcgtttgttcacttgttagctctaatttcccatttattatttttgcatcaaaggctgcttttactgctactcttaatgaatcatatgcataactagaatcgaacatcattactcccattcttccataggttattgaacttatataaacaggatcgtatggaccaacatttgataattcattattgttttttaaaaggcatccatctgctggtaaatctaaatcaactgtgaaatttttttgtataaatttagctactaatccacatttcttcctgatctttccttgcgcaacacttgtagatatgttaaaaacacttgcaacgtctatattgcaattaaatgctaattttaattcattataataggtgaactgattcatgtcatagataaatgaaacaatctgtttgcctgtcatcccttcttgattcattattttacttaaagatgttctttgcgactgcaagctgggcttctctattatatctcctacaatcttagcaggaaaagagtaggatatataaagagggtctaattcgtttgttaagcgttgaaaacgctgttcttctagcgagccacctttcagtaatgatcccaaatagatgtatctcattgtattggctgttgtaccgtgttcatttgtttcatatatgagtgaatgaccttttttatccggccaaacactatccttaatgagaaaggtagatcgtgtggttgcatttaaaagagctaagtgttctttactgccagtttcaatgtctatgactttctgaggatatttggatagtgttaagacttgatcctttttactattgtctggatttttgtatatatcttcattgtcaacgcatgaagaaactacaagtgaagcagttagtaagataaagatttcttttttcatgataatatatatttataaggtgaataattgctgtgttaattttgttgcattttaatataggatctttatatatcaaatgttccaattgaaatatttatgatcggaaggataagatactgctctcctttagtttgtggttgctcaaatatttgctcatagattggagatggttttaggtcaaaatttaaatttgcatttttagtgtaaaaagcacaaaaccattcaggaattccattcatgttgtatgctccatatctctcgataattattttgtaaaaaccgatttctttcccttcttttactatattagtaatacctccataattagttccaatcttatattttaatccttttaaaggatggtgctctttttctgataatttgttgttaatatatttttcttttatacattgcagaggtatttcgaatctgcctccggctgaatgtagtatgaagggattttctttagttataatcaaatatttaaaatctactttgttttttgagattaactcaattaatttgtatttagtctgattattgtcaaaattagtattaacgagggtctttttttcaactagtaattcatactcataccctttttcataatggaaaccctcgatcgcagaaatatttatttcttgaaaatcgacttgattttcttcttttgctagtatatattcatgattttcaatatcttcattttggattctatttgtttctgataaaagaaatattttgacagtttctgttttgattagaggggtgtcttctttattacagctgcttgtataaagtgctaataataatatatttaataaatgtctagttttcatatattgaattttatgtatatttgtgtaaatatttactttgctaaagtagatatttattgattttatagtgatgaatatatattaactacttgagatgccgtatgaataaatgataatttttatcatgattgttttctttgtaaaagtgaaggtttctaaattattgatttttgctgtaaataacaaagctactaatctttatataatttataaatgtgattatatttgtgctagtttgtatttcttcctaatgttttcaaggatactaaatgtcttatccaactcctccttcgtatgcatagctgttaagctgaagcgaagacgggataatttttccggtacagctggataactgattgggtttacatatattccttgctcaaatagtatgcgagctgcttctttcacattgtgttcattacgtaccattacggggaatatagctgattcggtattaccataatcaagacctagggtttcaagtccggttttaaaatattcgatattttcggctaatgtatttctccattggggttcttggtcaatcagttggatggcttttattgcggatgcggcggtttgaggtgtagcggcggcggaaaatatattttgtcttgaataatatctgagtaaagttatgatctcttttcttgctatggcataacctcccacgcatccgaaagctttactgaatgttccggttatcatgtctactttgtcgagaagaccataatcttcaataattcctcggcctgttttgcctaatacaccaataccatgagcgtcatcaacaatgagaaatgcgtcatgctctttacatacggcataaatttgatcaagaaaggcgatatccccatcttgggagtaaacgccatcaataattacaaagcgatttttgaagttctttgagttgtttaagacatgtactaaagaatcaatgttgttgtgaaggaatctctttgtattggtacataaacaaccgtcaaatacactcgcatgagtaaacatatccatgattgcgatatcttctttatccatcatggccagtaatgtgctgcaatttgcggcgtatccggatgtataggttatcgcatactcatttttcaagaaatgagcgatctcttgttctaactgctcatgcaagaaattgtgtcctccgatcaaaggactggccccagctccagctccatattgttcaagtgcgtcaatacctgcttttattacttccgggtgatgcgatagacctagatagtcattagatacgaaactgatcatttctttttctttatttgaatatggatcgaccactttcatatgggcactagaaccggtcaaagagatgacacgataaggtaagtgctggattttatgtctatatgatatataatcatcaacctgttttgctctggttaataagtcttgacctctattttcgaagtcttttaatgtcatgttgtcaaattcgttttgcatataaacccctctcttttaatttgacaaaattattgacagttattatattatgaaatgaaactattttaattatttacttaggtttcttactttataaagaagattaaacataacagattctccattatcattctctaacgcaaaagtggaacgaaaaataagttgccttattaatgaacttttctccttatttgacttaatctttggggggtgactcctatgtaagatgccaaatattttaatggtatattattaattagttctttttctttggttataagatcctcataaatagcttcggcggaggaaccaagtagcaaggtctctcttgttattttccggcataaagcatcttcgagaacaattcttgcaatcttatttatgtttagggaggtttgatataaatcagctaagtctagcttcgataatttccagattacacagtctgtcaatgcttgtatatgtatgagtgatggctgattttctttaagggaaaagtacgagttggcgaattcgcccgggaaagaaaaccaaaaggtgatttctttgtccggatcaccatattcttgtgcagtccaatagcgtaggataccactttctatgaaataaagatatttttcgtaatcaccgattcttatggtaaactcgtttttcttgatttcttcacgttcgaagtgttcacaaaaaagttgttgttcttcgggtgttaatcgtagtcctttatttaaggagtctataacgttaacggattgctctattaataatgcgatgttggttttcatgtgtttagtatgtttagctggttatgttaatatattctaagaacaaagataatgctaaaagctggataatcaagatttattcaaggtaactgcaccaaaatatctatgaaatagagattaggaagaaatactgttcagatctgatgataaggtaggcttattgtatatttccatatacgctcttgttttctgtcgtgtgattcagtaaaaacatgtacgtgttttccgaaaaaacatgtacgactttttccaaaaacacgtacgtgtttcgcggaaagtataatcgtctttttaagatgtttatgttcaatgatttatataagaacattatttacgtgcttattgtctaggatttgccttgggatacgtatgctctaaatagactccggatactgaaaatcgggtgggaaaagtaaacagggatcgttggcaaacttaccagcgatcccactaaatccctattataatttcgcttgattcacttgcggcgtgcggatacccggtttcaattctccgttgatgatagttaaccggccatcttggataaccgctcccgctccggcacgggccaactgctcatattcgcccagatcgctccatgctttcgtggataggtcgtattgaagtaaggtggtattgaatcggtaccattctaccggatggtgcatataggccttggcttcggcttgcaggcgggtaatggccgctgaatctcgcgccgcctccgctttcgctaaatggatcggtcgggcgatggcggctaagaaacaatcgtagttcacacctcccataaataagattttatccgtttggaaagtcacggcacagcctcctgttagggtacggttcgttccgtccttaaacgggggaagaacggtctcttgttgccaggtaaaagttgccgggtcgaataccaatacatccgtcgggacgatcggttcctcttcgtttaggatgggctggaagcctccggctagataaatacgtgtgccgttgggactttctccggccgctaataccggttgtacacgggctgctcccgggaagtccggtagttgttcccatcccttttcgatattcgcgaggttgaggcgtaagaaggtatggcagggctgtccgttctcatttccccctgctacgtaaatctcctgtccggtaaaagcggccgagagattatccattggagacggtaaggggggtaaggcgcaaaccgctacctctcctttcgtggggttataggagatgcgggagacctcgaccaaggaagaatcactgttgtttcctccgatgcaaacgataccttccggggtggaaaccgtagcgccgtaggcgacgggacgaggcagtcggtcgatctctttccagccttcgggaagaaggacgaatatctcgctataatatcgcttggctcctccctcggtgacgggtttgtccggaaagttgcaacctccggcaacgatcaatacgccgttatggatgccggcgaacggggcggaaacgccaagggaagccgtatcggctgctcccggtagatccggtaattttgtccagtttatcatggtgttctgttttttagatacaggctggccgcatcccgctacgcagagtagcaggaggaacaaccagccggtgatttgttgtttattatgcatagcttattcttttattgcccggaacgtagaggccggcatgcccgcctcgtttataagattcgctctcgtgaagggttgccagccgtagcgtaccagcttcgggtgagtcacttgatcgttccacacctttactttcccgttctctaccacggcttgcgccggatagtaaagtccttcctgctcggcgatctcgaatgtacggatggggtccccatcggaggttgtcaagccctttgcgtaatcgaaagtgatataggcggcgttatcggtaaacgttgcgctgcggaacaaagggccggatgggattacgttatgtccgtaggtcttgttcaaggcccaatgtgccagtcgttcgccaatctctttttttcgggtagggtgaacgtttaaagaatccccgcgatcgctactaacggccatacccgtattcgatacggtttgcgccaggcggcgttggctgtccctgaaccaagtccaactcgggcggtctatgctggatagttggacatagtagaaaggcaggtctgcgttccaattctggcgccagctgttcaccaatagcgggaataatcgttcgtgtacttccatattatgggcgttcgattctccttggtaccaaataatccctttgatgggatattgatgaaggggttggatacccgcctcgaacagataacaaggctcatacggatggcgttggagcgggttggatgcttgcttgatgtttaaggccgcccgttcacgtacccaatcttggataaagtcgttcttcgtccaatcctgtaagatatccggaaactcgaattccagtgttttccggtcgatccatgcctctgtaggcgagccgccaacagcgttcaatatcaatcctacgggtacttgtaagctatcggccagcatacgcccgaaggcaaatcctatggccgagaagcgtgcggtattccgcgtgtcgcatacttcccattgggtgtcgtggtaatattgcaggcggttcaatgaatccagtacggaagcgtcccattccacggcgtaggtctcccagcggggctttaggtcgaataaacggatttgcgagtgttgtttcacgtaatccaattgttgctgttgttcttcctttacgctctcgtttacccggaacgccatgttggattgtccggagcatagccagacttccccggctactacatcccgatagttcagcgtgcggctgggggtagaaaccgttaaggtataggatttcccgcttacccgtaaggggtcgagcgtgacagtccatttcccgttcgtaccggctacggtctccttcctttgtccggcgagggtaacggttactttctccccttggttggcgataccagatataggaagcggttgatcccgttgcaagaccatccggtccgaatagatggcaggaagctgtaatcctccgtaatcgccggttagcgccccataaacggtgcgggccaagataccggcaccttcagcgttgggatgcaatgcgtcgggcaatagatccggacggtcatataatccttcctgcaaatcgatcaaggttgcgccggctatccgggcgatttcttcgataagcgcttgctccatccagtaccagtctcttgtaccggatttaaaacgagaatggcggtgagatatcggagtcatacggcaaacccataccttgcatctcggattggctttccggaaggattcgatcaaggaaagataatcccgaacgaaatcgtcccggtaattcggccatgcccgagggtccgtatcgttcaatcccagatggatgatcacgtaatccccggcaaacctcagtgccttttgatacgcttcttgttgggtataaggacgatatcccttgtttaataaagtagccccgctatgcccgaagttctccacttcgtaggcatctccaagcatctgttgcaattgggccgggtagcagtttgtttccctgttcttgattccgtagccgtaggtcacgctattacctacgcaagccaccttgatcttttgcgcttggctcataaatgcgaaagcgaggaagatggataagattcctattatttttctcatttcattcaaccgaattagacgttatttaagttgtttatccggagagtaaaccagtccttccaccgctttctctccatccggggtgacgcaaacgaacgtaaacatccatttcaccagacggacctcgggggtattgaacgtaccgaccggaagcttcatgaacaccttgttccagcctttttccagatggaccggggttggtttacggcttacgcagttctcgttccccagtgggatctcattggacttctcccggtgggtagcggtccatacggggggcgttatctcttgatcatttacccagatacggctttctttataatcccattttccttgcattggaggtagatccatttcagaacggctataattttgaaattcgatccacgtacctacctcttgcgccttgggcgaatagatccaagtccatgcgtaagcggtatggttcggttgcgggtctttataggcaccgggaaccagcggtccccagacatggcgcaggtagataccggcaccgatggcgtcgtgcgtaccgtaatttttcccttcataggtatattgcgcttgaagcgacttttccggagggaaagaacgggtcagttccccatcattcgggaaagggtcggtgatacgccatctcacgttggtttgcttgacgtaggcgaacgggtatccttggaaatgatgttctttatgccataacatccgccgctcaaaatcgacaaatgccttatgttcctcgttatcgggatcgataggcagcatcgttccgttcttatcgaaatattgatagccgccgcccaaccaagaacgttcggcgatcgctaatagattcggatacaaattattctcccggatcaatttgtcctccggctgtacgacccggtcgtgccatacggcaaggatcgtacccgccaaatcatggcttccttgcggttcattgtaaatacggcttttgtataagccgatcaagtcggcgaacgtatcaaaatggttgatataatggaaacgggagtcgatcgcaggaatgcccggtcgcgcttttccccggtaactccacatttgctccatgtcgatctcacccggtttgtacttccatcccgggttccaagagatcacttgtttccctttcgcacggatataagcgaccatctcgggtacgaacttcggattggtaaactttacctcgtccgtaccgatatgtaagtaaggaacctcctcgaatacctcgcaaacctcatccatcaatagttttaagatcgccataccctccttgctctgcatatcatgacggaaggcccgtatgaaagcggcgctatgtcccggcatatctacctccgggatgagtagtacgttatgttctttacaaaagcgaaccagctcctttgcctcctcgatcgtgtaatattttccgggcatacggctcatattgcagctgtcgttcagcatcggaaagatcttgctctccagacgccaagcttggttctccgtgagatgccaatgaaatacgttcatcttgtagcgggaaagtacctcgatctcccgtttcagttcttccatggagatatagctccgccctacgtcttgcatgaatcctcgtatgcggaaagcaggccagtcggtgatctcgcaaccttggatggaatatcgcttcccttgccgctcggtcagttggcgcaaggtttgtatcgcccaataagctccttgctcggataccgcccggatggttatcccccgggaagagacgcttagttgataagcctcctcggagttgagggggattccgtccaatttgtcaaccaaggaaacctctatcttgtatcggctgtccggttggacgcttaccggcagctcctccaagaattccattaggatggaacggagtttcccttcggaagaaactgcgatttccttcggatggaacgaagcgtttgtccggacgtatttttggggcaagggcaataaaacaggattccgggccatcagaggcccggaatacaagaaacttaaaacaattgcaaaatgcagtatatatcgcatatacttagattattgatgaatgatatcctgtaatttgatagcttggaaggtcatatgtgctacgcttgactcgtagaagattcctaccgtttccttatcgatcatcgaaagacaggaatatccccacccctcggcctcgtctaataagacttgatgctccgtgggccatgtaagtccaccgtccagactcgccttgatcgtgatatgattacgccctttcgtcgtgttcggattggagaagagtagaaggtccttgccggtgatgttatccttggcgtttaccttgatcaagctggccatacaaacggattcctgtaaggcgctacggctggaaggatgctctgtccatgtcttgcctaaatcctttgtggtggccacggcacggctaccgccccggttatcacgcatatttaacatcaatacgcccggctctacctcggcaacttgcgcctctgtggtattcgtgcgggctaagttatgcaggtgccatgttttcccgcggtctttgctatacataatgccggcgttgggcacacgggtagcgtcgataaactggatcgggaagaccaaggtaccgtcttgcatcgtgatgcctcgtcccgggccttgcaataggaaataccaagacgggtcttttacttgggaggtgatattgatcggttcgctccacgtcttaccatcgtcctcacttttcacgagcataagttgggcggtctcgtccggtgtcattcccggcatggagttccaccaagcccgttcgttacccataccatgcgtccatgcggctactacccagatcgtattggtcttttcgtctaccaagatcgatgggtctcccacgccgttttgtccgtggggcaggccatccgtttgtttgaaagtcatggctactcgcatcggttcccaagtttgtcccttatcggtactgcggcttactccgatatcgattttctcttgcaggtccacgctgctattatagcgaatatcgtagactccaagtaatgttccgttattcgtcgtcactaatcccgggatgcggaaggccgccgatccgtcatccccggcttggcgtacgccgatacctacatggcgttcgtccacctttcctttccaagtgatgtcgatcggtttgttgttgatctgtgcgttaggcatcgtggtcgctacttttgccaataaggaagtctctggcttcatctggatacttacccagaaatagttgatgcctttaagcatcggttgcttagaggttagttttaccgtgcgcgacaagggggcggtaacctcatcttgccgtacggaataagattcaagagccttacgggtatttcccggtatatggctggatatgtacgtaacgggactgaaatgttcccctttgcgggatggagcttccactccgctataaaatagacgtatcgcttggatgtccgacaggtcgacattgtctccgatctgtatcgtgatctcgtttaatacatcccctttttgggccggtatccgcatctcgtaaagtacattgtcgatccggtctatcaagatggggatttgttgctctcgcacataaagactgtctgccgcaaaagccgtttgtacgatgaaaagaaggcagaaatacaggaaagtttttttcatgatgttttttgtttgtaggttgaaattaatagatatgtgaattccaaaggtagcgatattcattcatatgaacaaagcccctttggaattcgtgccaaaaacctagttatatccaatcgccttaaacctatgtacgattagtatccgggagtctgtttcaatgcggggttgtttgtcaatgccccttcattgatcggccataataaacgtgattcttgtgctgtggtatattttaatacataatccttaccgaagcgtctcaagtcgtaccaacgtttaccctcaaagaagaactcgcgaagtctctctttaaggatagcttccatcacattctcgtcgcccgcctcaaacgggttatcgttatagaaacttcctttgtcattcggataagccacctcgttcttatgtgcgttaaaatattcggaaccgtaagcacgctcgcgaacggcgttgatctctgtagaaggatcttctccgagcaaggccttagcctcggctaataatagcaaggcatccgcatagcgatagataggataatcatcgtaccaacttctttcgttgctaccttccaaggtggttccttggaacttgtattggattggtgcgatatattccaaggttccgtcttcgtgctttttgtaaaccgccttcaaggtacctttcaagcgggtatcaccttcgcgaaatgattttaggtaatgatctttctttacttggtagcgcattaagccttgtaggttgtatcccggtatttcaaggaatggagttcctgtctcgtcacagtagcctgccatgtactcacgttgaggtaccatattgttacgccagttatagtctctccacatcatgaaatcatcctccttaccactatggagcgcgaagatcatctcgctgttctccttattgttgaaagagaaaacgtccgtgaatttctcttgcagctttaagttgccgttttgttgaagatcttgcaaggctgtcttggctacggtataatcgcccgtgccgccacccatctggcgtccgctccatagataaacctcacctttcagcatcaaggtagcggttttagaccaataacactttccttgtttataagaataatctccgccaaaagctttttccgaggcatcgatatccttcttgatcagatccatcacctcactcgctggagaagcggccttatcaaggtgagagatatccaattcgctacctaaggttggctccgtagtaatgataacgtctccccaagagcgtaacaaatggaaatagatataggcgcgtaaaccgtaagcctgccctaagtaatagttcttttcggcctcgcctaataaatcggtctcgttcgttctacggatcatcaagttgatttggttcagtgtcgtataaaaattagcgaagttgctgatacctgtaaactctgcgttgatcgtgttgtatgagaaacgctctacgccttgggtagcctcgcctccgaacggctgatctccgtagatgtctgagcgaggttcgcccaatacgaatatgttataactggattgtgaacggagcaatccgtgtaaacctatgttgaatgccttaaactggtccggggatttccaatagtttgcgtcggaaatactacttacgggttccatgtccaaggagtcgcatccgctgaaattcagtaatgagactgctgccatcatggctataattatctttttcataaatgtctgtcttttttaatgggtttgactaaaatgttacggataaaccaagaagaaccgttttaggagttgggtatctaccgttatcaagaccttgaccataggtagtatctaccgccggttccggagatacaccggtatatcctgtgatgtagaacaagttttgtccggttacataaacagaggcattgctcatcaaggctttgttaatccatttctttggtaggttccaagtcaatgtgatttcacgtaaagctagataatcacccttttcgtagaagcgggagctgttgttgtcaactgctgtcaaaccattgttggagcgagtaatattcttcttactcaactgatcggcatagtagaacttaggtatatccgtattctggtttgtctccgaccaactgtctttcaccatatcgatgatgttaaacgaaccttgatattgtccaagtgaacgtgcggctaagtcgttatacagcgtatgccctaacgcataatcaaaacgagcgtataaagagaaatctttatagcctaatgtcgtggagaaaccaccggttactgtcgggaaaagattacctactttcacgcggtctagattgttgattacgccatcattgttcaagtcggcccaacaaacgtcacccggctcgatcggttgcttacctgccttatcctttaaagcttcccatgcggcggggccatacaattctccaattgcgtcgtagcggttattggcattcgctttcacgtcatcccaatccttgaagatatgatcttgcttgaaggcaaataaatcacccagcttaccaccttcttgttttccgccaacccatacgacttcacccttttgcgggtcgtatacttggtaacctccttggcggttattttcgttcccattggccggaagcttgacaatcttgttcgctaccgtagataagtttgctgatacatcccaactgaatccgtttacgttgtttaggatattcgcttttacttccatctcgaaaccttggttacgtaaagttcccaagttggttttgatgctgttgaaaccagtgtaattgggtaaatccaaatctgtcaacaaatcggaagtcgtacgattataatagtctaggataaagctcaggcgattgttgaagaatcctatatccaaacctacttcgaaagatttactttgctcccaacgtaatccaccgtttaccaatttgtcattatagaaacctacagagccatcatagtttgttatgatcgatccgttcgcgtctttctgcccatagctgccatatacgtcgtagtatcctaatccgtttacgttaccgttcacgccgtagctgatacgaggcttcaggttagagatcacatctaccaacttcgattccttaaagaactcctcttccatgatattccaaccagcggagatacccgggaagaagccccaacggttatcgctcaacttggagattccgtcataacgagctacgaccgataataggtatttgtaattgtagttatagtttacacgggcaaagccagaaaggatacgatagccttccttgtagctataggtataggtacgattactaccagcgttcaaagtagggatgtcatccgacggagaattttcggtccttgcgttcagcgtatattgatgccaattgaaatactcgccaccaagcattgcctccagattgtgtttttctttgaatgtgtctgtgtacgtcaaagtaacactatgttgctgttggttctgctttatatatttggcctcagccttacgggtaagattcgggctagtggcgttttgttgttggtaagatttctcgaacttatctgtttgatcgtctacgtggtatagggcgctattctctttcaagattaatttcttcgggatgatctctagatcaaaaccgatattataggtagagcggcgggttccattcgtattcgttaatttatctttgtagtaaagagggtttccatcacccgtgccgaagcctgaagcgggagatccgtcttccatgtatgggttccatgtagggcgttggctcattgtgcgatagaagaactcatatgatccgatccaaagacccggctggcgagaccatgtataagtcgttccagcgttgactgtcaagatcggaaatatcttataggatccattgaatgtcccggagaaacgctcgtagctggttcccttaatgagaccgtcttctttgtagtaacctaagctggctgcgaatgtacctttgtcgttacctcctgtgatattgatataatgatcttgcgtgaaagaagggtcttggaaggctgcgtctttcatttgccctgagtaatccttgaataagatttgtttattcggatcggttgggtcttgcatttgttgccaaccttctgccaagaggcctttggtactgtcatccaaataacggatatcaaataggtcattcccgataccgtatcccatttggttatccatgcctgaacgtcctgttctttggtatcctaagcgattgtagtaaatataatcgtgagcgtttaagtaatcataacctgtgcgagcaaagttggcacctcccttgaacttgtaagagacggaagcggatccttctttaccacgtttcgtggtaaccaagattacgccaccattggcacgggcaccgtagatagcggttgaggctgcgtctttcaatacttggatagactcgatgtcggaggggttgatgtcggccaatgagttgcgcacgataccatctacaacgaccaatgcgccattatccttacctgttatggtagctccgccacgaagtacgatatttgggtttgctcccggctgaccggtcgtgtttacgacgcgcaaaccagatacggttccttgcaaggattgtccggcgttagacatcgctgcgttttccagtacggcgttatccaatttagagatagaggttgtcaaggtcgctctcttttgtgagccaccgtaaccggttaccactacttcgtctagctgttcggcgttttcttgtaggatcacgtctactttggctttcccagctactggaatttcttgtgtcttgtacccaatgaaagaaaatactaatgtggcgtttttgttggatacggtgagagtgtaattaccgtcgaaatcggtaatcgttccatttgtcgtgcctttttcaacgatagacgcaccggggacacccatgttataggtatccagcactgttccggagactgtctgctcttgtccgtacataaatgccggaagtaggagcgcaagcattaagagcagtagattcttcttcataatgaattacttttttgttgtttatttagtttattggatgagattaattagcattcgtcggtcatattagcgactttcggacgtaagaagatcacttggattaaaagtgcgatgagtaccaatccggctagcatggcgaagtcatggccaagattaccagcgtcggtagattttcctagtatatccgtgatggcggctccggcaaatacaccggtcatattcataattccataggctgtagcccgataacggggggagatgaattggcaaaggataggcatattattggcgtcgaatataccataaccgataccgaagcaaagaccaccgccgataatcatcgggaagttgtgcccaaatcctagtaataggagagagggtatcgttaatgccaaaccgatggcgcctgtgtatacacgtccccggacattccgctggatccatttatcggataaaatacctccggcgattacccctataaaggaagagatagcgatcgtgaatgtagataacggaccggcctcggacatatccaacgagagattttcagcgaatagggtagggagccagttctttgtcgcccaacccggtaagctcggcgtggcgaaataaagaagaatgatccaaaaagcgatgttcgtgaataacatccctaatcctttaaacgtaccggaaatcggattctctttcggataattttccagttttacggcttgttccacatgatctttcttatcgtgtaagaagatgatcaagaccacgctataagcgatgccgatgataccaaaccaatggaaagtcgtttcccacgtataagcactggccaccgtagctccgaatccccccaaggcttggcctacgtatagacctgtcatatggatacctacggctaatgagcgtgttttctcttggtgataatctgtgataagcgataatccggcaggaatatacagggcctcactgacccccatcaaggcacgtaggtaatagatctgattgaaatccgtgcaataccccatcatcaaagtcacgaaggaccagacaaataagctacccacgattagccacttcctgtttaccctgtctgccaccataccggccacagggctcatgaatccgtagatccagaggaagaccgccatcaaacgtccgaagttcgccgcagactctagttccacgatatccaccatcatagctgatttcatggttgatagcatctggcgatccatatagttcagtaaggcgacaacccatagtaaaccgactacgatccaaggatataatttcttatttttcatttgattgaggaaaataaaaaggaaaacaaagccttagaaacatcaggagccacggttgtgacccctgatgtcaattgaccaattttcagtattttagataaagttatttagaaagaatttcgtcgcagagtaaactacatttgagaagcattctaggaatgtggaacggacctttgaatagattgcctttggcagattgagagagactaccatcgaagtgtaggtagccataccattccccatattctttgtcggggagatgattaaatgtgtaatcgtttattagtttgtgcatttcgagatatttggcgtcgccagtcgcttggtaggcgtaaagcgtagcgataaccgcctcgcattgtggccaccagaacttcatgtcgtgccaatactcttggggagggaagtttttgcaatccttgaaatagttgattccgccgtacgtcttatcccagccccagtcccaagaccagttgaggatttgtaagcccatctctttcagttgagggtcccatcctcggtatttggcctcttccaagataaaccatgcggtctcgatggagtggccgggattgatggtacgcccggcgatagagtcgataaactcaccgttgggtcctactgtctccaagatagccttgaattcgggatgcatgaaatcacggcgtagctcggctatggaatcatcgatttgttgtgtaagtatgggatcgtttatggcctcacggatgcgtgccgccgtatcgatcagtatcatgcagaaagaatggcctttcgccacgagaccttcacgaaatttaggctccaataatcccggggtattcttatagtgtaatacttgcttgaataagttcacggccttctcagcatagcctttgtcgcctgatgccaatgcatagtgggccatagcgatcgccgcaaaagtctcggagaatacgtaacggcgtttacgtacagggatgcctgtcgctgtcacctcgaagaacatacgtccgtccgtatcaaaacaatgtttctcgatgaaatcgataccgtttttacaggctctcagccattcttcgttcttctcaatgtgattataggcatatgccaagataaaggcgaatcgtccttggaaccaaacggatttagtggagtccatcagagtaccatcccggtctacgcaagtaaagtaaccgccgttctctttgtccagtccgtatttcatccaaaaaggaagaatattggaaagaagctcattccgataggtcttgccccaataagctagatattccgatggattagataaattgtcaaacgctgccataccttagaatttattacatctttcaaagaaattgatagcctctaattccgctttcattgcggcctcttcttcgtccgtcatattccggaacggggtacggttcttgccgagatctaatccgatcaatttcatgatgcgttttcctccgacgatattaccacggtaattgcagataacgttaataacctcctgagagaagttttgtctctcgcgagctgtctctaagtcaccggctgcccaagcctctaggataccggttaattcttttccgttatagtttgtggtaccaccgatacctccttgcgctccacccatcgcaaggcaaggaagaatcgtttcatcctgtccgtgcaacatgtcgaatttaccatccttgtataaacgacattgattgtattcgtataagctctcgtatgtatatttgataccggcgaaattagggatacgcccgtctactgcttttaagaaatccagcatagggaggaaagcgttgttaaacgcagggatatgatagtagtaaaacggtaaggcaggagcgccgcaagcgatctcctcgcagtactttaccaattcctcaattcgaccgatacgagggaaaggggtagccatagcgccaataccccaagcgccgatcttttgagcatgttccgctaaattacggctagacttaacgcatgtgctacctacgtgcacgattaccttaaagccttccggagctgcttccatccatttctcggccaatttcatgcgttcttcctctgtcagcatataaccttctccggaagaaccattgatgaatacgcctttcagcccgtttttcacaagaagtttcgcataatcttcaatgggctcgtaattaacttccccgttctcgtagaacggagtaaagggagcatcgatcaatcctttaattttatccatatctgcgttatttttatgagttttaacctctgattttaattatgctgcaaatataaataaaatattttaataatataatggtgctttatcgagaaaatgaaataattatttattttttatttaattcctttgaaatacatattaaatcatacctagaattttagatcgagatagcaggcaggctcctaatatacccgctctttcacctaatttggatactttgatctgagtatcacgggttaccaagttcaaagagtacttcctgacggcacttttaataggtaggcttaaatattctcccgtctgcgacaaggggccgcccagtacgaccagttccggattgaaaatgttcatcaatccggctattcctttacctagattaaaaccgatctcctccagtatctcaatggatagcatatcctctttgtgaatggcgtcgatcaagtcagagagcccgatgtattccccggcatcgattttactggccaatatggtgttgctaccctctttataccgctcaaggagggtacggtatagggcagaaccggaagctccagtctcgaggcatccttttttaccgcaatggcaaagaatctcattctcgaagaagctgaagtgcccaaattctccggagaaacctgatttcccgaaataaaccttgccgtctatgatgataccgatacctaatccccaagatatattgatgaataggatatttttctctccttttacgactccttgaagatattcgccgtaagccatggaacgggtgtcattctctatatagatctttatatgtagtttttcctcaaggatttgagacaagggcttctcctcaaagtaaaaaatgctatagctatatccggcgaaaggatttacccgtccggatatattaatgccaatgcttaatatcttttcccttgggatcggcaacgagtttataaattcattgatgcattcgcaaagatggtctaaagcggctggtgtgttttcgagtgtataagggatattctgctcaatgcggatcttatctcctttaaaatctaatatggctagattcagttgatctttcagtatatctacgcccacaaaatagccggatacgggattgagcccgtaaatactaggtttacgccctccgctagtctcttgttttccaaagtcgagtatataaccgtcctcttgtaattcgctaattagcttagtgacggtggggatactgagattcatttctttacatacctccgctatagtagcgtctccattggccatataataatgtatgatcttctttttcagaaggccactgcgagtattgtcatcggacgagagcaagaacttagttgtcatggttatacctttattgagtgattagggcaaaggtacaataagttttttcaaaaactaagcgtaataaaataaaattttttcataaggagctatcttaattgtaagaatttgtaatagaagttgaataccatagtctgcggcggactctgtcactcgtgacatctgtgataaacgcataggaaagaaaggataatattacactaaaatccttctttcacgatccgtttgatcgggaggaagaatcgttcgatcaggcgtaattcttccgttacgatctccgcagaggcttgcgtctcgggcgagacgggcaggtcgataccgtaattggttctcaggccctctggaaaatcgatatccgccgtatagtactcgtcggtggggaccaatgagatattcgataccactccgtttaccactccaaactcctgatccgggaaattggagaaacggacgatcgcccgctggcctctccggacttttcccgagcgtgctatcggtatgcgcactttccccaccagccggccctcgccttgcggtacgacggtgaaagccacctctccggatgggatatactggttctcattccagtacttggtgaaagtcacgacaccccctaccggggcgatgaggcaataacgcaacctccactcgttcatgctgttcagcaattgttcccgggcggtctgtaattcctgccgtagcgtaaattctttctcgctccgctccagcgtcagatccagcaaggattgctcttgctccccgatctgtatcctgagattctcagccgaggctgccgccccttctagcgaataacggctttgcagtagggaagcccgtgcggtctcatgctcgtaggaggaaatcacggaccggctatacaataatgaatcccgggcgtattgccgccttgtcaaggcgaattgctccgagagggtcttccgctgccgttcggtctcgttatagtaagccttatacaacgctatctgtttgcggatggaggtcattttttgcggataataatcgatctccctgtaattgatacaggcatggagcgccgagagtagtcccgagtaagccgcttgcatatcacccagcgatagctccttgtactttgataatgccttgtccaagctatccacgtcgcttccggatcgttccaacgccttatccagatagatggcatcgtccgtgtcggcgtgattctctatgaccgccagccaatccccctgccttaccggacgattatccctgacgagcagctcctgtatctttcccgccgcccgtgtcaccaccgccgttgcgggatgttgccccgtcaatgtcatgtcagccgtgatcacgtcaggatacttgaagaaacagctccccaccagcaacgctacgaccacgaggaataacagcgttatcccccaccgtacgatccaggccggcacttgccccatcacctcctgtacctcctcgctacgtaactctatatctttattatttttcataaggtggtttatttcgtttggtggtaactacgataatccctcttttcccttttggaccgtatatagcagcatcaacaccttttaggataaaaatttcttctatttcggtcacaggaaacgaaagtatatcataattttgatatggaacgtcatcaacgacaaataaaggtggctcataattttttacaggatccgtttggaatgaaatggctccataatcttgaataaacacacattccttatacacatgatctactacataccacgaaatgttaacactccccaatagataaagtaaggacctcatatcctgtatatgccattgttctatgttttgtcgatagattacacgactggatggcaaagatccagaatacaatccattatatttttgttttcttctcatgcttgcgataatagaaacttcatcgagatttacggttttccatatatccggatttggttgtgataagtttttaatgggagtaacctctaatgtcatagctattaaatcccaggccaaactcaatcgtgagggatctgaatctatttggttcttaagtggaagcaatcccattcggaagtctggaggcaatgactggaaatcagtctgttcttgtatgtttagtacgacacggccacacaatagattcttcatagaatctactaaagcgaacgaggatatcccttttggaaaatgttttttgtcaaaaactaaataagaatctttaggattccagactttttggaaaaaaatagaatcttccgattgggccactaaatataataatttcattggcacttccctcgaagagttgataacggataagaaccattgttctttattttcaattattttaagaccaaagccattttcactcatcattggcaaataaaaattcttacggattctatctcgattttcgcattttaagatatatctttctcctggatttgcataaatatgaaagtagcctattccgggcaatagcgttttcacggattgaaccgtatcccctctctcatttataattactccagtgatggatatctttttcttgtcaattccttccgctgtaaaaactattttacatgagatattttgaagaatagatccactttcaggataaaacgtaacaatatagtcggtctcccgttccgatgcagaaacgggagataccaaaaaaagaatttggataatactaatgataatagatttcataaatttatatattcattagtaccggcaaatcaggtaagcgacgttcagggcacacttctatgttgggagaacaagttccatagtttctagggcaattagtaccatctcgaaaatttccacatggatcagaaatgccaaaagccgcattacatgagtatcctgttgctccacaatttgtattacgctcgttacaaggccgtcctcctataagtttagccattgtaaattcatttagacggcttttttcaatcactttaaaatttttcataacgcaatgatattaagtttttaaataaatagcctttttattataatcttattcagctattttgtgacaaatgaatttttataaattctttgagagaatccttaaggtatgtacatgtatcataatgtttatctttaaatatattttctatccgtttatgggggcaacctccaaaacaaataggaagataaggacatttagaacatgttttatcttccagtggatctgcggcatagaggtatcggttaagaattttctgatctatggattgaatagttccttctgaatccaattttgctatggcatatttttgatcgcctataatttcccaacatttatataagtatccttctggatctattgtaaatgtgtgtttatttcgaatagaacattctgtaaaagaggaatctggatatccacataaattggttacgatacctctgtcatagtagagctgttgtataaactcagatttctcttgtctattgaaaagtaaagaacaagaagaacttgatttagaagaagtagatgttataaaagcaggataaattccaatcaatgggttgctcttatatcgttgtaatatgaaagaatataaagttataaattcagaagaattctctttattcatatttactcgtatactaattcgtatttctggggcagaagatgctagcaagtctatattctttatagttctagaaaaagtatcgttttcattttttgtgaattttatcttgttgtgagtctcttttaatccatctagcgtaatttgtatgtgttgtaacttcatctccttaaagagttttataatatccggtgatatcaagaacccattagagattattgagaaagaataatttttatcgggaatcagaatcatcttacgataaagtgattctatttgcttaatgcctagaagaggttctcctccaaaccaaactacgtgaatatttttaatgttttcatattgttctatgaatttaataattgagcttatgaccttttctgtcatataaatattacgtttgcaattttcaaaacagtaagaacacgagtaattgcaatccatggttggagctatcgttagatttaagatattgatggagcgtcctgctaggataatacttttatacagtaagaactcatcccgatcattttcagtgatcatatggttttctttcaaagtttgataaagttcatcacatcccaagtctttctcttgtaaaggtgtatgtctattcttgttgactaataaaatcttatatgtatcctctgctatttcgatcaaggcattagacaatgtattatatgcataaaatttactgtctatctcaaataggaatgtgtacattgatattttcatggtatttgcatatttagattgttaagtgattaattccccaactccaactggttcttcaccaacttataataagtcccccgcaaggccgtgagctcctgatgcgtcccttcctccacgacgcgtcccttgtccagcaccacgatcttgtccgcgtcacgtaccgtgcttagccgatgcgccacgaccaccaccgtccgtcctttgtagaaggcgtgcaactgctccatgatctcccgctcgttgttggcgtccaaagcgttcgtggcctcgtcaaggaagatgaagtcgggattcttgtacaccgcccgggcgatcaggatacgctgtctctgcccttggctcactccgtttccctccatgccgatcttcgtattatagcccaacgggagagaatcgatgaaatcccggatattcgccaccgtcacggcatgcagcaggcgttccttgtccaccacctcttcgccgggggcgatgttgttggcgatcgtatccgagaagataaaaccatcctgcataaccgaaccggtcttgctacgccatacgtgaggattcaagttcttgagggaggtatcgccgatcctcacatcccccttgttggggttgtaaaaaccgagcaggagtttcacgatcgtcgtttttccgctcccgctggcccccacgatggcggtcaccctgttatggggtatcgtcaggttgatatcctccagcacgtaatcccggtctgcgccgtcatagctgaagctgaggttttccagccgtagcgtcctgtcatcgggaagaacattcagccttatcccgcctgcctgttcctcgtcctccttcccgtgtatctcgccgagccgctccagactgatcttcgcgtcctgtagggatcgtgagaaatcgatcaattgctcgataggcgaagagagctgccccacgatgtaggtcaccgacatcatcatacccagcgtcatatccccttgcacgacggcccgcgccgcgatgaaggagatgagtatgttcgtggtctggttgaaaaagaccgccccgagttgctgatattgttgtaacgccaaccccttgatccctatcttgaaaagttttacctgtatccgttcccatttccatcgcatcttggtctcgcaattattgagcttgatctcctgcattccggtgatgagctggaataggttgctttgctccccggccgcttgcgagaaacgctttacgtccagctccctcctccatctcatgaaggcgagtacccacgccacgtataagccgttacccgccaagaagagtcccagtatggtccagtcatagtaggcgagcacgaacccgaacacgatgaagttgacaaaagagaagagcgtattgatggatgtcccggtcatgaaagcctcgacgcggtcatggtctccgatgcgctgcatgatatcgcccaccatcttggtatcgaagaaatgcaggggcaggcgcatcagcttggcgaggaaatcggagatcaaggcgatattgatcctcgtgtttacgtgcagcaatatccagctccgtatgaagtccacggatagcttggcgataaagatcaccaattgcgatataaggatcaaggttatgaaacctaggttgttgtcccgtataccggtatctaccaagctctgcgtgaggaaaggcaggatgagttgcagtacgctggctgtcaccatgcccagcacgagctgtgccatctcccgcctgtagggcgatatatatcggaaaaagaatccgaggttacgtttcctgtctctctcctcgtcctccatcccgtagaactcctgccccggttccagcaagagcaccgtcccggtatcctgcccgtccaccttggtactgacccagcaccgcttgaactcctccctcgtataggtgataagtcccgccgccgggtccgctatgtagaacttccctttccttatcttgtagcaaaccacgaaatgccattggttccagtgcagtatgcagggtaggggacattccttttccaattcctccaccgtgatccgcacgccctgtgttcggaacccgatcgcttccgccgcctcgctgatacccagcatggagactccttcccgtgtgatgaaggctttctcccgtaagttctggatcgagtacacacgaccatagaacttggcgatcatacggaggcagctaggaccacagtccatagaatccaattgctgataatgtggaaacgatcttagcataaattaaaacattaggatatagacatgatttagttcttatttcttatacttgatcagcattatgacgggattggaatcctcattcaatttcgtcgcgatttcgtttagcctacctttgagcttcccttctttataagcctcaatcagttcaggcgcatcaaagggataccagttcgcgatatcttgattaatagatgaaatccaatagatcggtctttgatataaaaaatcagtattatatatttgatatttgaatatagaatcttcctgtttgtcgtataccaacctactcaccggtatttttctcgttttaatatcgagttttttttctacggttctcataaaataataacggcttgtcacctcctctacaaaaagaaatatttctgtatccatggaatatatagagggtgtcctcacgataaaaggtttaatatgaccatttggcgaataggaatatagggtatcggatgagagattcataagtatccaattatcggaagtggcggttgtagcaaaaaaagtaggaattactttttgatcattatctccgaatataaccagtgttttctgttctttagaaggaattgtaattttctggataatacttccgtcatactttgagataatcaaatgataaggctgttggtctgccaccattccatagcctttgttatcataagtgatcagattatccttgtcataattaaaaaccttaaggtagtcactctcggggtctaggaaattaaagcttcttttaaagtccccgtctaaatcatatactgatattttccctgtatgtgtaacaaatagctcattgttttcctcatctagtgtaattcctgcaatccccggatattcttcgacaccttgtcctaaacggtttattttccgtatagctttccccgttttccggtctaaaatgaatatgttcccgtcgtttgtgttgttttttactattataaatttttcgccgatatccatgacattaccatgtgtgataaattcgtcagtcgtttccagcgcaatatattctacatccataatatcctgaaggattagctccttttctgggtaatctttgctaacattgatcgtgacaaactcgtctgtcgattgcttatcttttccacatcccgctaaggcaaagaggaggactgctgaaattaaatttactttcatgctagtatttatttttcttgtgttttatcagcataatcaccggattggactcttcatccaatttagccgcaatctctttcagtttgcccttcagtactcctctcccgtaagcctcggcaagttcgtgggcttgcaatgactgtccgattacgaactcctcatctaaaggtctcgacgtcatatccacttctcttttgctggtataatcaccattgtatattttaggtatgaataaagaattttccagtctatcgtacatcaatccggaaattggaaaccctctccctgtttcaaaattaaattccgctttcaacaggctcatgaaataataacggtcggtaaaaacggttggtataagaaatacttcaggaggatccatggagtgtatggagggggttcttacgataagggggattgtcgtattagcatccggcaaatagtggtatatggtatcggatgatgtctccataagtacccaattggtatgatctggaactatttggtacacagcggttggaactggaacagcccaagcttccccgtctcttgcgaccgggcttttaacttcatcaaaaggaattgatattttccgggtgatacttccatcctgcttggaaaagattaaataatatggaggtatggcgtttgacgggttttccagactattatctggtacataagagatcaaattatcccggtcgtaattaaatgtatttatatgagattccgtaccttcggctttgaaactccttttaaaatttccgtatagatcatatacagagattttacttccggtataggctataacaaatatttccttgtttgcttcatccagaacaacctccgtaatacctacatattcctcgccaccttgccctttcctgttaatcttcttcaaggctttgccggtttttcggttaaaaacaaacaaattcccgtcgttggcccagttggttattaatataacttctgcaccaatggccattactttgccttgggtaacaaactcatcatttgtttccaacgggatgtattctacatccatgaaatcctgtaatatcaattccttttcaggataattctttgtaacatcaactatgatgagttcatttgtcgattgcttatcttttccacatcccgctaacgcaaagaggaggatcgctggtattgtgattatccatttcattattcttacgatttaaggttaaacacttagggcgatacgttcgctcaatcatgctaattacaaaaataggttattttttctcgacatctcttctttttgctcaaaacttatagcggtgaatggaattctatccgttatttacataatttaggcaaaggcttagcaatggatgttgtttcctctcgctatcttgtgggtcacttatcgaaagatcgaatagttcgcttatttccgggtcgttgattcccggatcatccttttcggactccagatgccagctgacccatgtttgtccttccaacttatccagatcattctctagctcataatgcaatgtgggaaggtggaaaacgactatagtcgcctgttggaaatatttcctgtcggtggttatcacccaatcaacgggtacatcctctattttcaactgtagatcttccccatttatcgtgttgaatacgagcatcacttttttaccagcctttacttggcaatctacgcctgctacctaatcagacacacgccaatccgtatattctttcagcccggcttctgccttgtagtaataatttctgcatctttgtatagattccggaatcatttgcccgcaatccctccaaaatcgatccagataatgtttgtgtactatgtatgaggaatctttcatgttgggaagtagtgtgaaggccatggaataaagcctgaggatgtttacataccaccagcttctcaagtcaacgctcgtcttagaggaaacaaattgatcagagaatttaatcaatccctcagtaacttgaaataatgatttcagccttcgggctaggcttgtcgtatgcatgaccgattcttcgttctggcggtaataataaaactcaatgttggtgataaccatcctctccgcttggcaaaggacgatgggacaccataactcatcctcatgcatgatgccttcctcaaaacgagcctgcattttatgcagatattttcgattgtatatatatttaacaggggtaggaaggtaaaaacaagttctgacgagccagatgaaaccctctttcccggaaagtaccttatggggcgattcgccggaaatccatttgaagggttcatttatacttccatcttgatcacataaccacatattccccatcactacgtcggcctgatatttgattgcctcatggtataatagagataatgagctttcttttatccagtcatcgctatctaaaaaagcgatatactcaccttgggcaacatccaaacccgcattacgggcagcagacgctcccccgttctcttgatggatcaccttgatacgatcctctttttttgcgtattcgtcagcgatctttccggacaagtcggtcgatccatcatccactaggataaattccatgctcaaatcaccttgacacatcaaggaatctatgcatgcaaccaaatatttttccacgttatataccgggatgatgaccgaaacctctattttattatctggcttactcatggccataaagacttatagaacgtcaacatgttctccctaaatacctcagaggaatatttttccaagtatcgcttgcggccgtttttaccgagacgtttcgcttcctccgggttttgcagcaggtacaagatcttttctgccaacaaggagacgtctatctctacgctatcagaagatacgataagaggtatttttaatgcgcaagattcgtctactacctcgtttaatccggaggtagcggtcgctataatgggcaattcatgcatcatcatctccacagggacataaccaaatggttcgaacaaggaggggacgacaccaacatcggctaaacgatataactcatataaatcttctttatttaaaagtcccgtgaacgtgatcttggtgaagaacggtttagcatttcgcaaaaaaagatcataatttccatctcctattatcatcaagcggctttccggataatcctccaataccttcataaaggttctaaccaaaaaatgcccacctttaatatcttccatacgcccgacaaaaagaatgattcgttctttttccattatatgccatttctttttcaaagtcttttgatcgacagactggcctgtcgtagcatcattcaatccattagggacaatcactatcttgtccggatcaagtccataatcatgcgataataagtcttgcatatagctggataaacagatcacgcgatccatcttcatatagtccgctttttcctcctcaaaggcgtatcgtacatcctcactccatacatctgaacggtttccctttaagattgcccgtagccgttgtgggttatcatggattcccgcagtccagtccgatgagtgcgatacggatatgaccttacaatcaaaagcctctctcagttccgttgcgagatcctcgttttgataatgattcaggtggaaaaccaactcctttcggtcgcggatatgaacccgtagcaaataaacaaggttatggaagtacaacttcctttgttccttatccaaaaaattccattgttctgagcagggagttgggaaataccattgggtaattccttccatttcctctttccgtacacacttcccgtcacaaagtatgtttacaaggaaaatccgtataccactgctttttagggcggttgtcaactcatggatataggtaccgacaccaaataccgtacctctgcttttctggcttatgatatatagattcatggcacaattctttagataaaagttttccatgaggaatccatcgcccccagttcggttaataaagccaacccttttccagcgtaaccagaaaggagccccatagaaaccgtctcttttgcttgagataaatccgaattatcctctcttgatccatgctccatcgcaagagcagaccgttttagcaatactggcggtatatttaaagcgggacaaacccgcaatccttggaagaacctatatgcgtcttgccattcatcccagtctagttcttccgatgccatctcgatccgttccacgatttgcgacaaactatccaatgcccgcttggaagagaaatttcgccgtaatctagcgagccaatattccccatatccacacattccctcataacggctgaaattaggacaaggatcataccatacggctcggtacattcgttcgtcaaaatcatcgaacgcctcctcttccaaatccaggaaccttttttcgagcaggtaagaaaatccaacccctatgcctgctatccctttctcgtaatccgcccgataattggcatgtagctgttccaacaatcccctgatcagatccatggcgtattccgaatacaaatcgtcttgtacatatcgggcataatggaaaaagaaaatggaaatccccatctttccgtgtaataagctcgggcattttgttaatgtgccgttcaataagagttgattggaaatcagactcaattcctcttccttttccatggcattatgtggattttcgattttacttcttatatttggctatcatgataatcggattatcttcttcatcaagtgttgaggcaatttcttttagtgggccatctttcagctttccatcttcataagcctctactaagtctgcggcttccagttttttcatgaatgcaacatccttgctgttctggaagtatagacggtcatgaaaattgtaaaccatagtcattggctccatttttagaaaatcattattatacatctcgcattcgtaaatagtttctttttgtctgtcatataccaattctacaacagggaaaccgacttccttttgggcattaaaaatattttctaccgtttgcatgaaacaatagcgatccgtttggacacccggataaagaaaaatcttggtttccatgtcttgaattgatggggttcttacgattcggggtatcagttgttgatttgaggtataatggtagatcgtatcagatgatgcttccatcaataaaaagcccttatcttgataaggtatttgtgggctgttataaatacaatatataatctctccttccgctgcttctgcggttaccagtggataaatattttttttgtaaggtatcgagatttccttgatacttccgtcttttttagaaacaagcatgaaatagttccgtgttgccacaacttcatctttcaagctaagataaccgtcatgacaaagtagatagtcttgattgaaattctccagcttatcataatagaaattttctttttgatttagtgatcgcttgaaattcccatcttgatcataaaccataatttttcttgaaacataattgttgacaaataattctttttcttttagatcaaatatacaccccaaattgatcgtgtactcctcagctccttgtccgagccggctgatctttttaatacctttcccgtctttcccaaaaagaaatatatttccggtattgttacggatggcatctgatatgagaagacaatctccttctatatcattgggagtgccagatgtgatatattcatctgatgtttccagtgatacatactcaatgtcaaaaagatcttgcagtatcagtattttcttagggtaacttatcgtaacgtctactgtgataagatcttgctcttgaacatttttattattacatgctaataaaagtagaaaaataagcgtatagctccattctgtttttctcatattcgaatatataaaagattatttattattaactgtacaaagattcaattgcccaatcataagatctaagtcagaaggtgaaggacaaatatattgatacaaacaatcgcagcatggtttttggttacgtatacgcaaccaagactcccctatttctatttctttttttacgatttgataaattgaatctgttttgatatttcccaattttttgtgcaatatattcgcataaatatctccatttgaaagtatgaaaagctttccgaaattatctttatttatgatatgtttccgaaaaatatctttcatgcttatctttgttgatagaatatcttcttctgttaagaaagtgttttttgctaaaaaagagatattatctttggtatataatggtcttaactgatatttatcaatatcatatttctcaattaaggttactgcttcattacaatcctctaaagaagtaacttgaaatatatactgaaaagggattttttgctggtcaagaaatatacaagtgttattcataagagaatgatctactggcaaagagacatatacttgatatgaaaaatttttcttgagtgatgattctaacaatggaatatgagtgtaagaacattgtatataatttgagtaagacatttgccccaaatagtctattaataaagacccatgtggtatatccttccagtcacctataatattataagttaaattaagagaaaaagaacgcaggtattctattaatgtttttatattaactgtgttgtctaaataaatagttatttcacagagtgtttgcaacaagttctcaagtgaagaaaactgatgtttatttttgtgtaagtctttataatttaaatatggtaatatttgcactggttttccttcggacaaagatacttctatgatatctcccataaatttagactgtagttcatttatgaatgttttaatctctatatcatcatatatatgttgtggcaataatactacaccacaatttttttcgcatagaatttcttttaaaatttggataatttttaaattgcaagtttttatatatttgccatctaatgtattatagagtaaagcttgtttgtttactatatttatatatacataaggttctattgtaaaccaataatttattttcataactttattaaattattagagatttaataatattgaaataatcaaaaggatatttctccaaaaaagaaaaaatgttatctatatgtttttcaagatcttcttttttctggaattctgggcattcaaattcgtgcgtacccaatttatctaaattatccaatgtaaaaatgcaaatggaacaatgtctacctgcataacaattagcacatatgcgcttgaagtaattgtagtaatattgatattttttagaaatcagatcaatatcaataattactttgtcatttacttttcctaaagaatgtttgtagcttactttttcgcaagggagtaagtcgttataggtattcatatatattttacgttgaaaaggagaacatgttcctgttggaattatggatacattttcatataataaattaagtgcattgtttagataaaaattaatagaataatttgctaaaaacttttttgtttttttgaaattcaatagctcttgatgcatgattggaaccaatttagaatcactttgtgtaaattcaatatcgctttgtgttctagaatgaaacatcttgtctaaattttctttgtttttagaatttacatgatctgtattcaattgtgcgatcattgggatcttgtggtaacgattgtaaataaattcatagatttcttttacagagttcaaattatggagaacagagttgaatcttatattcttgtcaaagaaaacgggatgtttcttatataaatagtcgatattttcaatagctttagaaaacgaattcttattgctatgagtaaatattctatggccttgcgctttacaatctccatccaaactgattaatagttgaaaatcattattaattatgaattctaagtttttttgaattagtgttgcatttgttgttagattgaaatgtaaatttaaacatttatctatattcattttttttgattcatttactattgtttctataaaattcgtattcattagaggctctcctccaaaaaatccaatagtaagttcgcttcctgttttttttatgctaaagatatacctcagaaaagttatggcatattctttatttatatttcttcgttcttttttgctaaaagtgtaaagatctcctagcgagcaataagtgcaatttaaattgcagtggtctgtcgtttcaaatactatttgttcgatatttttgatattatcttcgattgacacgtcttcaatatcttcaaaatctattttgtttgtatctgagaataaaccatgactctttagatattgatatttcttaaaataatatggatcaaacgactcttccaaacctctatttttgataactttctctaatttaggatgaatcaatatagataatgaaaggtttatatcataaagatatatgttctttttattagaataagatattatggtgctttccatattgaataattttagtataataaaaaagaggactgtcatataaattcaaatttaaacttaataggcagcctctttttcttctaagacctaatttcctccataacttgctgatagattaggatcatggttttggcaaccacacccaccctttagcaccttcatctcacgtttctcaaggtggttctcactaagcttattcagctttaagcttttcagcacttgttgcttcttttcgctcatggccttttcgttttaaaattagacaatatccatcacctgatggattgtatgtttcaaatatatacttttctatgcgtatattttatagccaatctgactgtttttttgtgtattggcttatttcttcaaaaatcctttctgaatccagctacgaattgtactttcagatcttcctgtagcgagtgcgattgatcggacactttgttttttgtccaataaggcttgtatatcattcaattctttattgaaagtgggatttgctgttgagcaataggttcctttcgcatatttctcttgtggagattgtaagatatggagataagagatccagtcggttgcttctcgcaagtcttggagttgtagttttttcttgatggagttgatatgtcctcttgctgtatgataacttatgtagagcttgtctgcgatggtagttatatcctgttctcctttggcgatcgttaagatttccatttctcgtttactcaattggggaatgggcaatatttgccaatcgcatttcattggatcataagtttggtatatgaggtggtcgtaaccgtttaggtaacatcctatttttttgcagtttgtatatgagatgatgtctattagataaatcgggttcgaatcttcgcagatggggatgagtcggtggtaagtatgtagctccaccggctcttttaggaaaggatattttcgtgacaaccggaacaggcagaaaaactctccccgctcatttgtgtcttctcgcaggcgatgtaatttttgtggcaaattctccaagaaacttttccacaacagccaatcttcgggatgaatcaccctagaaaagaaatcatatcctaattccatcgcctctttcacggaatggccgcacagaaaaagattgtcgggcttgatgtggatgaattgcttttgaacgatatccaatacatagaagctatcggggataagggaagagattcctttacaatattgaataaatgtagacttttgttctttggcgctatctgttattctttctgcatattcggaaaaaatatcttcaatggtattcataatcagattatttttaggttaattttttagtttactcatgcagactgcattgctgtgattcgctatattaaagagtctgttccaacgatattggaatggagcgtgagaaggtagatttgataagtaattcagttgattaaaaatttcgttaaggcaatgctcttgccaaactcgtctccaaccagcccatccggatacgtgggttaggttagaataatagtaagttccgtctcccctgtttttaccgaattgataattacttccggatatatgtccgatgcgttcgtcatttctgaatttttttagtaatgtcgtacaaaaaccaaagaatgaaagagagggtacacagtcatcttctagtatgattccttcgggctcttgctcgaagaaccaagaaatcgaatgaaaacagtgtttgtcgtatccttgattttttccctgatatagtttaaatacttggcattcccaatcaatgtgggaaacaatggacgttgtttccttacatattttacactgtgtgtcattagttgatccatctactgctatatatagtcttctcggtttcacctctttgatacgatcaaatacttgctttatatttgatcgattaaaggctataaggagaatcgctattttggggtcgtagattatcataatatgtattagttcttgattaatgacaaacttagtatttttgttaggttacgcttagaattcctaataacataattcaatgcaagcatccaggaaaaacgtatcattgggggcactgtacagtgattatcacgtttaacgatcttttttggttaatagtgatagatcaactatatgatactgtttaatcctgaagcttgcatatgataaagaataatacctaattattttgtatgatgaaatctcccgtaagctgccctaggcgatgttctaacactagataaaagcatcctgtgccagcctgatctaaagagatggatacacattcacctgcttcgccggagactacttcgttatataggatagctccttgctcatttacaacttggacagtcaaatcatctagagcatcgataaaatgtatgctcaatagatttccgtcgatggatactgttggaggagcaggagtgacagagcgataataatcgtcatgccattcgcctttggtcggtacattatctccataaacagacagtggcgaaaagaggccaaatagcatcaataaggttaataattttgttttcataatattttgtttttctttttgcaaagaaaagctttattctctaataacaatgaacatggatgaacaattggcattttcgtttttgttcattttctaacactgattataggtcattgatatatagatcgaaatcggaggcttttcctgttttgccgctcatcttcagataaagtctttttcgtaagactgatatattactatggtttaataacatagaaagacgtgagggtttcacatggattctcactaaatagcataaccgttccatctgtatcggtattttagggtaagcttcttgaagtttttgtgcaaaagacggataaatagcgtttataagatgaaacaactcttcccaatcctcggtagatggtttccaatcctcgttttcatgaaagttttatatacagatgaattcttcaaattctgtaatgattcaatctgatgctctttttgggcatataatgcttggttcttttgttcgaactcctgccgtagctctttcttgagttcttcctgttctcgatctttctcttgtaaagatttgtttaatgtctctatgatttgttcattatgctctatctgtttttcatatgctaggactgttttatcataagagaaaatcttttcccggttttctttttggattttcaataggtctttttgtcttttcttgtacttaaacaaaagataagtggttggtagaattatgcagagagcaataagactgattacggccatccgtaggttcgcataggccgttcttactcgttcctccgctaaggatttttgtttatcctgttcatcgtaaaggacttgtctgcctctaatcgtattcgtgacttctatctggtcgagtgtatcacgcatcatttcatatcgttgattcaactccgcataaaggatccattgttttgtcgatagggctattttggatagatgataaacagcccctgctctcgtgtccaatcgcaccgctttttccgtgcattgttccaaatagatttttgctgaatctaattggccgcaatgataataatatttgcctagtgtcaaatagaacggataaatgttatttcccaatgcctgcttgtttgccatgacctcacgaagtagacactccgcttccgggtaggtctttgtttctatatacagactcgataattctgaataaacagagagtaccttcctgctctccatcaaatcgagagttttagaataacaggcgatagcgctatctttttgatggagtatcttataaatacgtcctagatctcgaagcgcatagacttgaccgatagaatctgctattgccttgaaatgcatgaccgctttttgctgataaggtaaggctcgctcatatacgtcttgttgggtataaagcatcccgataccgttattaatcctccccagtaatgcgtggtcttcaatctgctcctcattctgtaaggcatttaagagacactcttgcgctttcaatggatgatttaggttttgattgatccgtcccttatagaaccaagctttcgcttttcgttccagatcgtctgtttcctcataataatccgtcgcaatcgtgatcagcgagtcggtttcatacttaacaaaagtcttgtcttgtgcttctgttaacagcaaataataatgtgccttatcttttcgggataggttttctttgttctctatttgttcaaggagcattaaggcgctatccggatgttggggcataaggttctctatttttcggaagtctatggtttgatggcccattccatcgcaagagatccatataataggtattagaattaacaggaaaacaatgtttttcttcatctgcgtgttatttgttgggggtaaaaataatacaaaaagacgagaatatcttggctggaaatcccgactttttggatctattttttatttccattacaaatatcttgaataacagatggttacgctagaagcaagtcatccgcttatggcttgacaagtgaataactaacggcttgtcaagtgaataactaacgagtaggggtagccgtcagttaacggcttgggaagtgatcagttattcacttgagaagccttttcccagagaagatatacttactttgccgatgaagtatatcttctccgggcataggatatatacttcatccgcaaagtaagtatatatggataaaacaggcttttttatccaaccagccatcgttctatattccgggtctcagaggagaagttcacgccgatcttgaagacctcccgattgtctccggagaagggtagggcgtagcctttctcctcgatctgccgcagggcttcctcggcggttccgttgagcttgaactccatgatatagatgtattggttggtttgcaatacgaggtctatacgcccgttcgaggtatggtattccacttgcgtgtacaggccgaccagcttgaagacgatgaagaggacgttctggtaatgcagctccgtgtctcgctccggcttttgcccggcgatcacctcgtagggtgtgtcggcaaagaagctttgcaggcggcggaagaatgcgtcgtaattgccgctttccacttcttgaacaaaacgtcctatctcgaagggtgtctttgcggcgcttatgctcgtgtagaaaggcaggaggtatttaacaaaaccttcctctacctccaagtttggaaaacctagtttataaatcccaaaacggggatcatagcccttgatggttaggtatccgctttggtagatgacgggtataggattattagaggcggaatcgatgctgttcagcacatcggcgtcggtttccgtgttggccatctcgtagaggtcgtaatgggtgtgcttgagcaactccaccagataagagggggtaccggtctcaaaccagtagtctccgaattccatcttggcgaaggtgttcaagagactgaaaggattgtacattcctgctgagttagcggtgaaatggtatccgtcgtatcgctgcttcagctttagacaggtagcctcataggtcatggcttgcgcatcagccaataccctcaattcgttttccaaataagtatgtatctctttctcggtgatgccgcatatttctatgtaccggttatccattgatatatccattaggttgttgaggtcgctgaacacgctcaccttgccgaacttggtcacgccggtcaggaacgctaggcggatatatccgtccatgctcttcagaacgccgtaaaacgctttcagtatagagcggtaggcctcctgtaactccggattcccgatcgcctgtagcaaaggcttgtcatactcgtctaccagtatgaccactctccgtcctgttctctcataggcacggcgtatcacgccggtgaaacgatcggatggtgttatctctctctcgtctttcccccacaggtcttcccaaaggttcagataacgtcgtaatatactctctaatgccccagggtcagaatatctctccgcatttaaatccaaatgtaagatggggtatcttatccagtctttttccaatttctccatggccagtccctcgaacagctccttctttccttggaaataggcctccagcgtggacagcagcaagcttttcccgaagcgccgggggcggctgaggaagtaatactgtccggtagtaaccaattgatagaccaaggctgtcttgtcaatatagagatagccgtccttgcgaattttctcgaagttctgtatgccgattggataaattgtctggctcatggctttgtgtatttatgtgacttatatacaaaggtaattctttctcccaaaagggcaagtaacggcgcttttttctgtacggtacgatccgtggatggcgcgtgccgtgagcgttttgcctttccacagctatcgcgtgggctcaaccagccacttttctatattgcgggtctcggaagagaagttcacgccgatcttgaagacctcccgattgtctccggcgaagggtagggcgtagcctttctcctcgatttgccgcagggcctcctcggcggttccgttcagcttgaactccatgatatatacatagcgatcggtttgcaatacgaggtcgatacgcccgttcgaggtatggtactccacttgcgtgtacaggccgaccagcttgaaaacgatgaagaggacgttccggtaatgcagctccgtgtctcgttccggcttttgcccggcgatcacctcgtagggtgtgtcggcgaagaagctttggaggcggtggaagaaagcgtcgtaattgccagaccgtatctcccgaacgaactgtccgatctcgaagggggtcttagaggctctgacgctggtataaaagggtaacaagtatttgacgaaaccctcttccacctcccgattcggaaaacctaggcggtagatcccgaactcgggttcatagcccttgatggtcaggtatccgctttggtagatgacgggtatgggattgttcgaggcggagtcgatgctgttcagcacatcggcgtcggtctccgtgttggccatctcgtagaggtcgtaatgggtgtgcttgagcagctccacgaggtaggagggtgttccggtctcgaaccagtagtctccgaattccatcttagcgaaggtattcaataggctgaatggattgtatataccctcggacttggcggtgaaatggtatccgtcatagcgttgcttgagttttaggcaggtttcctcgtaggtcgtcatttgggtatcagccagttccttcacttcgtcttccagataggcatgtatctctttctctgtgatgccgcatatctcgacgtaccgattatccatcgacaggtccatgaggttgttgaggtcgctgaacacgcttatcttgccgaacttggtcacacctgtgagcagggcgaagcggatggccctatccatggtcttcaatacgccgtagaagggtttgagcatgttccggagccggttttgcatctcctcgtcgtgcaagttctgtagcaagggcttgtcgtactcgtctatcaggatcacggccctttgtccggttttgcggtaggcccggtcgatgattccggcgaaacggaggggcagggtcacttccgagggacgtgtcccatattcgtcttcgtaccgggacaggatgtcgtttaatatcttgtataagctatccggagagtcgtattgggagatattcaggtcaaaatggaggatcgggtattctttccagtccttttccagtttctccatggccagtccctcgaacagctcctttttcccttggaaataggcctccagcgtggacagcaacaggcttttcccgaagcgtcgggggcggctgaggaagtaatactgtccggtagtaaccaattgatagaccaaggctgtcttgtcaatatagagatagccgtccttgcgaattttctcgaagttctgtatgccgatgggataaattgtctggttcatatcgtcctatattttatgcgacttataagcaaagttacataaaatataggagaggaaccgtatctttagaagtaaattttcaacaataatatcttactatgaagttgatttacaattcgctgataataagatagataaatgtgcttgtcggatttccgtaaaaacacgtacatgttttcacggattcacgtacgtgtttttgggaattcacgtacgtgttttccgaaaaacatgtacgaataaaaaacaagtctggaaaaatagacaataagtaagaagttttttactccttatacttagccaccataatcacggggttggattcctcattcaatcccgctgcgatctcattcaatcggcctttcagcttacctttctcgtaggcttccaccaactcattggcttctagtttctttatgaaagcgatcccatcgttattgatgatctttagtattccgtgttcgtaccacatattaacgggtgtctgatctacgaaatcgttattatatacgacacactcaaagatagcgtcctcttgtttatcatataccaagtcggttctggggaatccggtttctttctcaaaatcccattgtttctttgttgtttgcatgaaataataccggtcggtaagaatacttggataaagaaatacttccggggccatagagcggataggtggagtccttacgataaagggtttgatagagtgatcttgcgaataactataaatcgtatctgtagatggctctactaaaacccaacttccattttgggaaattaattcggtattacgaggtcccgcggcccaacctcctttcgataaaaacggtgatatcttatgctcataagggagttcgatttccttgacaatgctcccgtcttgtttggacaggagccaaaatgcgctttttctcagatttatataattgccaatctcatcgtagcagattaagttgtcttgatcgaaattgtatgtcttcccgctattgaaattaaaatctttatcgtactttaaagttcgcttaaagtttccggacaggtcgtatacgataaactggctcgagtagtagttgttgataaacagctcacctttctcctcatcgagggcaatagacccgatattcgtgtattcttggctaccttggccgctgcggttgatttttctctggccttttccggtccggtcgaagataaatatatctccgtcttgtccgttcttgtttctaaggattatgagatttttgccgatggcttgcatgctggctgaggttatgaactcctcattcgtttctaatgggatgtattccacatccaaaaagtcttgaagaatcagttccttcttcggataatttgccgtgatatccacggttaaaaagtcgttagccggttgcttaccactttcgcatcccgttatcaggaacaggatcatcgcagagattgtgagtataagtttcatggtagtatgtttttaaaggtgttcttttggcaaacatatgcttttctcactgtcagaaaaatattttatacatctattttcgtgaatgtgttgtttaacattatctttgcaagtcaatgaacgtgaatatggaagatgattttgatataagggatgcccggatgccggaaaacgagcgagagtacgagaacgtgcttcggccgctttcgctccgtgacttcagcgggcaggcgaaggtggtggagaacctgaaggtgttcgtcatggctgcccgcatgcgtaaggaggcgctggatcatgtgcttttgcatggacctcccgggttgggaaagacgacgttgtcgaatattatagcgaacgagttgggggttggtttcaaggtcacgtcggggccggtgctggataagccgggagatctggccggggtattgacctcgctggagaagaacgacgtgctttttatcgatgagattcaccggctgagcccgatcgtggaggaatacctgtattccgctatggaggattaccggatcgatatcgtgatcgataaaggaccgagcgcccgctcgatacagatcgatttggctccgtttacattgattggcgctacgacccgtagcggcttgctgactagtccgctgcgtgcccgtttcggtatcaatatgcacttggagtattatgatatggagacgctgacgaagatcgtgctccgtagtgctaatattttgaatgtaaaatgtgagttgaacgccgctagggagatcgcttcccgtagccggggtacgcctcgtatcgccaacgctttattgcgccgtgtgcgtgatttcgctcaagtgaaggggaacggagatatcgataaggcgatcgcttgcttctctttggaggcgttgaatatagatcggtatggcttggatcagatcgataataagttgctgacgacgatcattgataaattccagggaggcccggtcggattaacgacgatcgccacggctttgggcgaggaccccggaacgctagaagaagtgtacgagcctttcttgatcaaagagggctttatcaaacgcacgccccgtggccgtgaggtcaccgatttagcttatacccatctgggacgtagccgggtgggggaacaaggttttttatttgattagacagatagatatggcaggaggaatgaagcggctcgctaaagagacagccgtttatggattgagtagtatagtggggcgtttcctgaattggatgttggtgccgatgtacacacgtgtgttggccggaacaggggattatgggatcgtgacgaatttatatggttggacagccctgttgctggtcttgcttacttatggcatggagacggggttcttccgtttcatcaataagaaagaggagcaagagccgatgcgggtgtatgcttccgtgctgtattgcttgctgggaagttcggcgctgtttagcgtagcggttttcgccttattgccatctattagcgccggcttgggatatggcgaccatccggagtatatcgggatgatggcgggtatcgtggcggtagacgctttttgttgcattccgttcgcttatcttcggtataaggggaaagcatggcgtttcgccgggattaagttgctgagtattttcttgaatattatcttgaatatattcttcttgatcacttgtccgtggttgcatacgcactatccggaggcgataagctggttctatcgtccggattatggggtaggctatgtattcgtggcgaacgtgtttacgacactgataaccttattgcttttgatcccggatatcttgccgggcatacgggcgagagtagacggaacggtattgaaacaaatcttgcgttattccttcccgatcctcattctaggtattgccggtatctttaaccagacggcagataagatcctgtttccattcttgtttgatgataaggagtatgcgaatgagcaattgggtatatacggcgcatgcttcaagatcgccgtggtgatggtgatgttcacgcaggctttccggtatgcctatgagccgtttattttcgctaaaaacaagagcgatgataataagaaagcctactcggaagcgatgaaatatttcatcatattcgccttgtttatcttcctcggggtaatgttctatatcgatatcttgaagtactttgtcgggccggcctattatcccggattacgggtggtgccgatcgtgatgttgggcgagttgttcttcggtatttatttcaacctctccttatggtataagctgatcgaccagacacgatggggcgcctatttctccacgatcggatgtgtggccacggtctctatcatcttgctgttcggtccctcgtacggttatatggcttgtgcgtgggcatcgttcttttgtaatttattgatgatgcttttatcctattttgtaggacaaaagaaattcccgatcgagtacgacttgaaatccgcgtttctttatttcggagtggcgacggtgttatacgtggcaggcatggcactgccgatacagtctgaatggctccggttgggataccgtacgatcttattaggcgtattcatcgcgtttatggttaaaagggatttacctttacgagaactcccgtacgtaggacgtttctttcgttaatcggtaggttcggacggtttggacggcgtggcgattggcatcgtgataacgaagcgtgagcctttcgtataagacggatctgtctttatcttaccgtttagccggttaacgatcaagcgacataggtaaagccctaggccagagccgggaatgaaatcattggtcttcgtgaaacgctcgaatatccattcctgtttgtcttgggggatgccgcaacccgtatctgttaccgacagggtcactaaattggctccgctatccagatggtatgaaagcgtaatgcttcctttctccgtgaatttatttgcgtttgccagcagatgtgagatgatcaagctgaaataagcgcggttggtcaagatcatatcattctccttatcgccttccaccacatagttgatctccggcttctcttgatatttctttacctgttgcatctcatgtaaacaaagctcatggattcgtgtgggaacaagaggaagggaatcattgccgctatcgagctgggcgatctcaaggagattgttcagcatggaagtcaagtggtaacagttttcatagataatacggctgaaagcctgtttctcgtccatggagatatcgtcgttggtgatgagttccgagaaaccgttgatcgcgtttaagggagtccgtatctcatgcgacatattccggatgaaggcggtcttcatctcctcgctctcttgtgccttctggttcgctatcaggacctgctcgttggatttctgtaatgcttgataaagagatctcatcttgcctaaccggaaaaagatatagaacacggcgcataaggctagaagcaatagggatatatataggtaattctccttcttgcttttctgcaattccaattccaatgatttcttttcgatcaccaacttgttcgcccctttctcgatctcgagattctccattttcttccggagttcttgcatacgcaaggtatctagcaataccgcatactctttggatgtctcataggcctccttgtacatccggaggctgtcgtaggcggcggcttttgcggatacataggcgattacatgctccttgtaaagcggtatttgtttggagaaattgatcaaggagtcgctgaactcaatgaatttcatgtagtccttgatgtttaggtaataattggcggaagtatagtatagctcgtattccggggtggtgctagccgcctccggataagccttcaataacttttggaactcatggaaataggaagtggccaaatccttcccgatagcctcggcgctgatggcgaggttggagtaggcgcttagcaagtggcgcttgttagtcgcgtaaggacgtttgctcatctccgggatattggagtatcctaagatcgtattgagatagcgggttgcgtatttccctctctcccaagggtcggcagcgtaggcgcatagcatgaaataggtgttaggcaagaaattgtatgcgtatcgtaggggcagtttttcagcctcggtcaagacgttgtcgaaatattctttcccttgcttgaagtcctccttaagcatgttctcctccatgacgctgttgctgacagccataccaagtacataattgcaggctattttctcatagggagacaatttgtcgggttcctccagcttgaataggcaattcatgaggactttccttcttggttcaccggatgtgtagaatatgacgcgcgtatcttggatcattttcatgaacgatacgaggctggttctggcttctccttttagctcctgctcggctttggcgatatagacatttgcgctatcggtttggtccgtgttgatataatgccggagaatctcggtcaatgccgcttccttatagtaattgtcattcgcttttaaggcttcctgatagagttgtttagcgtttactaatatgtcatcgtttcgtgagatatccatcaagttggcgaggatttccagccttgtgcgctcggaggtcgttttttgcaaggcgcttttaagcgagtctggtgtagtcgtttgagatgaaacgacaaaggacataaataataagcataaatgtattagatatcgtttcatacaaatagaatctcttgttgtgtttattgtattacaaatgcaaatatacgtaatctcaccataaaaaagctattaaatagttagaaaaacaaacaattgaaatatctttgcataaatatgggacaagattaataccgcatggaaaaaggattgctacataaacagattatggatttttttgtccgtaatttcgacgtcaggcaggacaaagaggatgaactggacacgatagaatctattaagaagggagtcgaatttaaggggacaaatttatgggtacttattttcgctacatttgtggcctctctcggattgaatacgaactctacggccgtgattatcggcgccatgctgatctcgccgttgatgggaccgatcatgggattcggcttgggattgggaatctccgatttcgagttgatcaagcgttcgttccgtaatttcgctaccgctactatttttagcgtgattacctccaccttatatttcttgatctcaccgatcagcgaggcgcaaagcgagttgcttgcccgtacgcaacctacggtatacgatgtattgatcgctttcttcggcggtctggccggaatcgtggcgagctcgacaaagagtaagggtaacgtgattccgggtgtagctatcgctacggctttgatgcctccgctttgtacggctggattcgggttggcgagtggcaatttgtattactttttcggtgctttttatctgtattttatcaatacggtttttatcagtttggctacgtttgttgtcgttcgtttgttgaaatatccgaagaaagttttcttggataaacaacgggaaaagatcgtgactcgttacgtgggtatcattgtttttttcacgatcgtgccgagccttttcttgagttataacttgatccggagtagttatttcaatgatcgggtacgtaacttcgtatcggaggagttgactttcccgaatacgcaaatcttgaataaggtcgttacggatacgagcgagaaaaaggaggtgaaagtagtcttgatcggccagacggtaccggatgagatgatcgctaacgcccgggctaaattgcctaagtatggattgaaagatgtgcatttagtcgtgcaacaaggcttcggacaagaggccacggatatcaatgagttgaaaagcctcttgatgcaggatttatataagaatagcgaggaggtgctacgtgcgcagaccatccagatagattcgttaaaacgacaggttgacaaatatcagagttataggcgtttgacatccgagttgatcccggagatgaaggttcttttcccctatgtagtcgaggcttcttgctcgaatacctatatcgtgaatacggagacggcgaagccggatacggttatgctggtttatctgaaaagtaagacgatcattaaagatgcggaacgtaagaagatcaaggaatggctgtcggctcgtgtggaaatgaaaaatattaaattactaatcgaataatttagactaatcagagtagaatgaagttgatgaaaagagtgtgggcggctttgttgcttttagccgcttccggccagttatatgccgatgagggcatgtgggtgttgaaggaattaaataagcagaatttggcgagaatggccgagttgggttttaccccatcctatgatcagttgtatagtgagacggatccttgcgtggcgaacgccgtggtaatcttcggtgggggatgtaccggtattacggtctctaacgagggattgatcttcacgaatcaccattgtggtttcggagccatccagcagttgagtagtgtggagcacgactatctgaaagatggttttgtctctcaaagtaaacaggaagaacttccggttccaggcttgacagtacgttacctgaaagagaccgtagacgtgagcgatcgtatcaacagccagatctccggtatcgaggatgagttccagcgtttgtcggcggctgattctatcggtcgtgtgatttgtgattccgtgggaaataatgagttcctagcggctgatgttgttcctttctatagcaataataaatatttcttggtggtgtacgatgtttatcgtgacgtgcgtatggttttcgctccgcctagctctatcggtaagttcggtggcgatacggataactggatgtggcctcggcataccggtgatttttccgtattccgtgtgtacgccaacgcggataataaaccggcggaatacaatgcggataataagccttataccccgagatatgtagcggaggtgtctatgcaaggctatcaagataaagattatgccatgacaatcggttttccgggaagcacggatcgttatttgtgctcttggggcgtgcaacagcgtatcgagaatagtaataagccccgtatcgaggtgcgtggcatcaagcagggcatctggaaagaggcgatgttggctagcgacgccgtacgtatcaaatatgcctctaagtatgcgggaagctccaattattggaagaactcgatcggtatgaataaaggattggcgaatctaaacgtgatcgaacgtaaacgtgcggaggagacggccttcgctgattgggtagcgaaagatcaggcccggggcgctaaatatggcgaggtcttgaatttgctggaaaaaggatatacctcgaccaataaatatagagaggctttgacctatttgaatgaggcgttttctagtggagcggagattattcgtttggcccgtatggtgcaatcggtggatattgaaggagctaccccggaagagattactgtctttttagaggatcgtatccaaccgttcttcaaggattacgagccgtctttggatcagaaggtactggccgcgatgatgaagatcgcgaaagaacgtgtatctccggagttcttgccggatatttatacgagcgttgataagaagtataaaggaaattatgagaaatatgcggcggatgtatttaagaagacttccttattgtcgtacgacaagatcgccgagatgttgagaaatccgaagcaatatgagaaattgagaaaagatccggcggcggaactgagcttgtccgtattggtgtctatcttccagttacagcagttgatgggtgatgcggagtatgatatcgctaagggagaacgtttgtatttcgcgggcttgaaggagatgtatccggagaaagccttgtcttccgacgctaatttcacgatgcgtttgagctatggttctatcggagggtatcgtccttatgatgccgcatggtacaattattactcaacggataaaggtatcctagagaaagaggacccgacgagcgatgagttctgggtacaaccggagatactggatctggttcgtagccgtgatttcggaccttacgcgaatgaaaaaggggaattgcagctgtgcttcctctcgaacaatgatatcacgggtggtaattccggtagcccggtattcgataagaacgcccgtttgattggacttgctttcgacggtaactgggaggcgatgagtggtgatatcgcttttgaaccggatttgcaacgttgcatcggcgtagatatccgctatgtccttttcatgatcgataaatggggtaaatgcccgaggttgattgaggagttgaaactggttcgatgagagaaaaaagagatgggcatccgtgatttccgcggatgcccattctaaggagcttataatgcccatcgtaaggtgctttgaatgcctattgtaagcgccttacgatgggcattgtactaaatgcctaatttagacttgattgctttcggtattgcgtccttatgcaccatgatgtaaatcgtcttggcacggacaaagctatctgacatgttgaggtaaccgccgaatgtattacgttcggttccccaagagttcttcgtgatataatatttcgtgccgttttgatccttggcgatgccggtaaggtgcatcaaatggtcatcggtcgtgacgaacgcctcgaagccttcttgacggacctgcggggtgacgtttacttccgggaaaggtttctcgaatttgtagacttcctccagacgttccttctcgtccattttctcgaagcgggcacggtcggtagtcgagtaatcttccaccttctttacctccgggttgatcgccacgccattcttgaaagagaagcctttctcgctcacgtcgccatcccagcataccgtgtaaccgttattcaacgcataatccgctacttccatcatttcattcaatggtaggttatacatttgcgcatgctcccagttatcgggaacctctacctcgaatttctggtaatacggatgatgcgtgaagcttgtcagctcgatataatcgtccatattcaaccctagggaggcggcgaatgtcttcggggtatattccttgccttgataggtgaatttctccggaagcttgcctaggtaggtatcgaataggttatcgattagtttgtaatattccgggctccgttttttcatatccacggcggtcgttgcgattgccttgatgtattttaccatctcggcatgattgtgccggtcggaatcgtagttgatacccgagtacacctcttcaggaacgatacctacttggttgaaagcgttcatgaaggtgtgggagagacttccttgaccgatattacctctaccttggcggacataattatcctgcaactggttcatgtatttctggcggacgataaacatctcggagagatcgtacgtcccttttcccatacggagtaattcggactccatgaaagaggtcgtggcgaaacaccagcaggttcccgtggatgcttgattcttgactggcgtggcgggtacctttactacatccgtaaattggtagccttgggcgaatgtgctcaaggaacctaacgctaaggcgcatgatagaatgaatgttctcattgtatatgaatttaagtttatattattattgtagagacggggcgtgcctcgtctttactatcggatgtggtgattagaagcctctttcgaattgggtccagaatgagtctcccatttctctccagcgtagcatcgtggctccggcgaaatcggcggtatatccggttaggtattcttttgcggcctcctcaccttgttgggtaagaatctctttgtaacggctctctacgaaaggaagttctgtctgccctttctccgtaaaatgggcgatagatgctttcatacgatctttagtcgctccccaacgtacggtggcgagtttgttggcacgacggaaagcccatacggcggcatcttcccggtaacggtgctgtccgcaaaccttgaagcaagccgggagatctttcgtcccacagaagatggggatgcgggggctttgtccgggattatcataggccatccaaaccacgccgcctaccgcgtcgggcagccagtcacgcaattggatcacggtagagtaggagcattgcggcacggctacaaggcggtagcgtttcacggcatccggtctgagtccgtttaacatgtttaccatatccgtagtcatccacggattcgctaccgggctgataatggtatctgtctcgttactatcttttttcttgacggcgactttcaggttcttcgtcatatcatattccgtcccctcatacgtctcggagagaagggccatcacgtcggtcacgtcaaccggtttttccggttttacgctgatcggaagttcctcggcatcataagaaagatgcaaggatggcgccagcttattcaaaatgaaaaactcgcggatgctgaaggatttcaattctcccgaatagttcccgccgccataggcctcccagaagcggaacggtttcttcccgtcccagaagcccatgcgcttggctacctcgaatacgttggcggaagccatgcaattctccttgtcgctcggatctaccttggagatacgggggatattggccgatacgcccacatgatcgtcggggatgcggatcgccgcccatacgccaccgatcttatccggaccctcgccgaagacctcgaaatgccatacctctttcggatccgctatcgtaaggcactcgccccagtcgccatatccgtatttctcgatcaactcgcccattaagcggatcgcgtcacgggcggtcgtgcaacgttgcaaggcgattcgctgaagttcctcgatcatgaacatacctttcttgttgacaagggctttccggccggtgatcgttgtctcgccgatacccaactgcttctcgttgaggcagggataggcggtgttgaggaattgatacgtagaccgcgcttcgggcagcgttcctttcgcgatcatcccccgggttccctcggcgtattcggtatgcatacgtccggtatagaccgtggttgtcgtatcgtgatcgtacgaggcggaaggtacgatatccatccaagtgcggtaattgctatcgcaggtgtggctagtcatcacggagccatctgccgaggcttttttgccgaccatgatactcgtacaactctccgggttcaagatcggctccggatactggatttgttgcgccaccgaaacagataggctggcgcaaagcataagaacataggtaaaaagtttcttcatatttcttgtgttatttagatgtttgtatcaattaaatttgtaggcagcttttcgtacgtcttttacggatttgaatggcttattgggttttagatgcttggcgaggaactggtagatgccgagtcgtatctcggaagcttgtttcgtgtcggtccggtcgaagctatgggcaccgggagcacggtcgaatattttgtagtcgaacttctttccttcggccttgagagcacgtatcatatgctctacttccactacgttcacgtcatcatcgctagtattggtatggatgagcaggggatcttgtagtttttccgcgtgccagaccggtgagcggcgtttgtattccgccatatcctcccggggagtcttcccgatatggccctcgtcggagaagattttccgataatcatcggtggaatatcccatgcgcatgatcacgtcgcttaccggtactccggcgaaaccgcatttatatttaccggggtaggtgaagaggttcatcagtgtgatcattcccccgtggctccatcccatgatgccgatacgattggcatctacgatatcgaaattctctaccatgtaattgcggctgacgtagacatcctcgttttctaatcctccgtaatcgatattatcgtaagtagccttgccataccccgtgctaccccggtattcggcggagaccacgatgtattcttgggtgatcagttcacggacgatatgggcgtaatacgtattgaaatcagcgtgtacgccactgtgcgggagaacgatcaaaggatatttcttgtcgggatccacatttttagggatgaagatataagtccagaacttcagttcgtttccggcgctcatcccggtaggattcgtttctttccaacgggcgggaccgcaaaggtagactttgtcgatatgggcgatgtcgcccactttctcgtaccataggaggtcatctaccttctttacgacttggtcaaaatcatgttggtagttttgcgctatggcatagtttgttccgaatataaagaagaggcaaaagcaggaaagatgtttaagcagtgtcttcatgtgacttatctttgaatttgtgattgactgtgattttctggctgtaaatatacaataaaagaagcgtgatccgtaataaacgaaccacgcttctttgataaattatgtataagttgtatgttacttacgtttcttcctgctacgaggagcgtcatcgtagaatttacgcttcggcttgtcatcgctacggctggaacgtctgccgccacggtcgctttcccggcggctgtctctgcctcctctaccgctatcccgtcggtctctgaaaccgtttccgctacggctacctccacggctaccacgactgcctttaccaccttcgcctttcgcttgcgccggttctacggagatacgtcgtccgtctacctcgaagccgttcatcgagtccatgacacggttggcttctccctcttctacctcgaagaatgagaaattatcacgtaagtcgatacgaccgatacgaaccttacccggtacacacttattaaccaactctataagttgaggaggtgtaagctcgtctgtctttccaaagttgataaagaaacgggtgtagccttcttccgcttcgcctctaccaccacgtttgcctctttctcttggggcgctctcgtctacaacctcgatatcatcgttatctttataatagtcgatcatccggttgaactccaaggatacgacacgcttgatgatatcttccttatccagccattccaatttacggtagatagaaggcatcaaactagcgatttcctcctcgttcactttcactttctcgatctggtccaccaagttgaacaattgcttctcacagatttgctcaccggtaggcatcttgcctttatcgaatttcttgttaatgattcgttcgatctcgcggatcttgcctttttcccttacgtggcagatagagatagcgatacccgtttttcccgcacggcccgtacgtccgcggcggtgggtataagattctacctcatccggcagaccgtaattgattacatgggttaagtcatccacgtccaaaccacgtgcggctacgtccgtagcgaccaataactggatattcttgatacggaacttctgcatcacgtaatcacgttgcgcttggctcagctcgccgtgcaaggagtcggcgttatagccgtcttgaatcaatttatcggcgatctcctgtgtctccttacgggtacggcagaagatgataccgtagatgttcgggtaataatcggctagacgtttcaacgcgagatatttatcctgcgcacgaaccatgtaatagatatcgcggatattcttgtttccctcgttcttcctgccaatgacgatctctttcgggtccttcatgtatttcttggtgatagaggcaatctctttcggcatggtagcggagaagagcagcatattgcggttttccggtatagccgccaagatctcgttgatactgtcggtgaaacccatgttcaacatctcgtccgcctcatcaagaatgacgttctttacgttgcttaagtcaaccgtcttgcggttcatcaagtcgatcaaacgtcccggggtagccactaccacgtgtacgcctctcttcagtgtcttgatctggctctctatactggaacctccgtatacagggagaaccttcaggttatcgatgtatttagaataatcgttcaaatcgtccgctatctgtaggcaaagctcgcgtgtcggacaaagaataagcgcttgaggctgatattgagagacattgatcttttgcaggatcggcaggccgtaagcggctgtcttgccggttcctgtttgtgccaatgcgattacgtcgttatcttctcccagtaagaaaggaatcacttcttcctgtacgggcatgggcgattcgtagcccatctcttggattgcctttaatatcggtgcggcaactcctaattcttcaaatgttttcaaaatgcgattgtgtatatatgataatattcagtggccgcaaaggtacgtaaataattcggattcatatcaataaagtaatatatcttttagcctttcacgtttcttatcagtaagacgtaatcctttcgacaaatatttctcggtggaaccgtactctttcttgattttatggaaagctaggtccatgagcccctcgttggccgtaaggaataccgtaatgctttcttgggcgtctgtggagagatgtttcacgatatcagctaaatgactcgtatcgatatattgattggaagtcaagtagtcctccatgatggcatcccggggaatatccaaggcggcgagtaacatggcggtgagaaacccggtacgatcctttccgtaggaacaactgatgagaatggggtaattatcctcgttctggaactgttccagtaccttggcgaactgatcggtattatctgtcacgaattgcaggtactcgtcttccatatataccccggcgtctcctttccgcattcgtccctcgataacacgttgggggcatcggcgatcttgccgaccgagatggggatttgcaggatatttgctttcgtatatttgataggggcggtgagggtttcttggttcgtacggaggtcgatgatggtcttgatccctagattatccaatcggatggagtcccattcgctcaagctgcttaactcgccggagcgaaataccttgccccatttcaccgtcttcccgtttgtagaggtataaccgcctagatcccggaaattctgtacgctatccataaccgccgagcgtgccccgatgatccgtgggtatttatcattaaaagaaaggcggaaatacttacgtgatatattatcgttcgtgatgtaagtagctacgccatccttgatgttggcgtaaatgatcggggactcgttggtgaaaagatccgggttgtcggacacggtcatcttgacaatcccctccattaccggatcggtttcccattttatcacgtaatttccgatgtcatcacgtaggcaaatagctcgtatgtcgggtgcgttagaggaacaacccactaacaggatcacactggcgaatagagagagaatctttcctaacattgtcttctatgataataagctttccttacaaagatagtaaaacaagtttttcccgcttcttcattaatgatatttaagactgactaacatacttcgccgcgaactccttggatatataattatcatagctttggcaaacctcggaggcgaggtccattccgcagcggatgatttttctccaagtatcctgatccagagagggaaggtcggcatggcgtacgtcatactttagaagtccgtagataatacccgcgttaaaattgtcgccggcgccgatggtactaagcggctggatttgcggggaatcgaaatgtcgtgtgaaattacgggtgtggagattgactccgtttgccccgtgagttgttaagaaacgatcacaataaaactgaatatgctctttgtaaacctcctgtgcgtcgctcttgccataaaggttctggaagtcctcgtccgagccccggacgatgtcggcgaattccagattttccagtacggtaggcatgaggcggatcgcctcatgagcgtgtgccttgcggaaattgggatcgtaatagatgatcgctttccgttcttgggcgtattgcagaaattctaccatacgagtccgcaagaccgggttcagggaataataagagccaaacacgaaaatatcgtctttctcgatcttaggcaggggcacctccagccgttgcgccgggtaatccttgtagaagatataattagcgttcttatcgtcgtccagaaaagcgagtgatataggacttttcccatcggggaaacggtctacgaactcggtcgtgatgtggttatcttccatgaaatcccgaatcatgtcgccaacccggtcgttgcccagctcgctgataaaggatacggggacattcaatcgacctaatgatatcaatccgttgaagacggagccaccgggaacggccttctgtggttggtcgttcctgaaaatgatatcgaggatggtttctcctataccaaagacttttctcatgactatatactggtttgttattcgttcttgcttagctcacggctcttggagcctaagtagcccccgtgatggcgcttggcgtaatccttgttggtgaaatggatacgcttcatggttccgaccacgaggatatcgcctattaccgtcatgacggtcgtggaggtagtcggcgtaaggcctaacgggcaaacttccttgggagcgccggtcaacaggcatacgttcgcctcggcggctagaggactatccgggttactggtgataacgataaatttcatgtctggcaccaaacccctcgtgagatctaccaattccaccagttcacgtgtctttcctgagttggagatcaataacatgatatcgttcttgcatacgattcccagatctccgtgttgtgcctcgctgggatgtaagaaaaaagcaggtgtaccggtcgagctaaaggtggtagcgatattcaaggcgatttgcccggctttacccattccactcatgatcagttttccacctaggtcgtgtacatgtttcactataagcgataccgcttcctcatatccgggtgtaacgggtatgttgcgaaccgcttccgcttcctgctccaataaagaggtgatattttcgtttaccatattgttgattgattgttttacggcattcctgcctgaataacgatcgcgaaagtatttatatttactgatattggcatcatctatttcagacaatttatctttttaagacgtttgcgaattcggacttcggcttccatttcgggtatccggtatcttgtgccagtttataaccgaggtcgaagaataattgtacttcttgtaacagaccactgtaatcatccgtgtcgggatgggtctggtcggtcggtttgtggtaagtttccgcccaataatgtgcgatatgctctttggcccactccttaccctgtttgcggttgtcgttccaacctttggcgaacatggccgggatgcctttttgtacgaaagggaaatggtcggagcgatagaacatcccgttataagcgtcggggtcgggcatgatgtaacggttgtatttcttcgctagctcggctagggtatcatccagctcggagttgccgtatccggtgatcgtgacatcgttgttctcgccccatagcgggaagacatccagattgattacggcggctatcttatcaatcgggaacaacgggtgctccacatagtatttcgtaccgaggaatccggtctcctcgcaagtaggggagaggaagacgatattccggcggggtttctctttcaaggcattgaaacaacgtgccatctcgagcatccatgcgatggctacggcgttatcggtagcgccgttgatgatactgtcgccgttgatcggtgctccatagcctagatggtcccaatggcctagataaataacactctcatccgtgttcccgctaccgggaatataaccgattacgttggggctttgctggcggtcgaaggtgttcctcatcgagacggttaccgtagatttcaaggagatgggcttgaagtctggcgatttagattgctcgattagttggtcaatgtcgtagccattatcggccagcaattgcttggcggcattgaattggatccagccgtttagcgggcaatgataggcatcgctatcgctgtccacatacatcttagattgggcggaagctcgtacgaccgaccaaggatagcccgctccccggtcttcatggatgatcaaaactccttttaatccctgtcgggcgccctcctcgaatttatacatccaacgaccgtaataggtcatgatatcaccgttaaaataatccgtgttgtcgcttccgagtcccgggtcatttacgataacgaccgctactttatcctgcgggttctcgattccctcgaaatcatttttcccatactcgggggctacgatcccatagccggcgaataccagttctgcgttgtctatatcgatctccggctcgatccgtgcggagaaagcggtgtaaccttccaaccaatctaaggggattttccctttcggggtctttaggaccatcgggtccgggcatcgtgtgcgtgaggatatgatattaacctgttggaaataagaatcgccgttgatgggtttcagcccaacctctttcatttggtgagcgatatagttcaccgcacggtcggccccttccgagaatggtttacggccttggcaggagtcatgcgagatggcctcggtgtatcgctttaaatgttccgtggtcgctacgcttttcgctttctctatatcattacttcctcctccacaagcggtaaaaaccaaggaagtgattgttagtaaacaggttattattttcatgtttctcatagaattacaatgttttttcaatcagccattcacctaagttgcgagtggctgcgtcgaaagcgacccccactttgactacttcccgttcgtcggccgtataaggaatcggatagcctcgatcgtcgatttgccgaatcgcctcttccgccgtacctctcagcttaaactcgaatacgtagatgtagcgaggagtttttacaatggcatcggcacgtccttgggccgaacgtacctcggcctcggtgaattgccctagtagcttgaatacgatgtagaaaaccacttggtaatgacgctcggtccggtcattcagctcgtagggtatgtcggcgaagaaagcctttaggcgggtgaggaaagcctcggtgtttccgctttccagctcttgaatgaactttccgatataaaagggagtctcggtttccggtaaatgcgcatacatggaggcaacaaaattcaaaaatccatatttaacttcctcattcgggtatcctaacgtatataaccgaaaacgttcatcgtagcttttgattgtcaaatatccgctttgataaatcatgggcacgggattattgatgttcgcccgatcgtccgaaagggatacctcggatacctctatcccgtccagctcccgtatatcgtaattcgttttccgtaacatctccgccaagaatgtcggggtaccggaagcaaaccaatagtcgtaaaagacctgtttactcaacacgttcaatacgctaaacgggttataaagggcgataccgctgcggaaatcaaaatggtagccgtcgtatcggcgtgtaattttctcgatggtatcttcgtatgaaagcttattcgcctcggccaaggcataaagctccggctggaaagtcgcctcgatctcgggcaatgtcatgccacaaagggccgcgtattgcggggctaggctgatgtcgttcaaatgatttaggttgctgaaaataccgacttgcgcgaacttggtgacaccggttatgaatacgaagcgcagccaaggatcggcatctttgaggaccgtatagaaagcggtcaataattcccggaactcgttctgtagctcttcgttgtgcaggttcctaagtaatggcttatcgtactcgtcgatcagtacgaccaccttccttccggttatctccgccgcccttcgtatgatggtcatgaaccgtccggaataggtgataccctctcctccggtatcatatattttttcccattccctcaactggcgttccagcatattctccaatgccttgcggctatcgtacaactcggcgttgaggctgaaatgaagtaccggatgctctttccactcggtctctagtttctctatggctaatccccggaacaattctttcttcccctcgaaatatgccttgaatgtcgatagcagcaagcttttcccgaatcgccgggggcggctcaggaaataagggacaccttggtatgccatttgataaatgaactcggtcttgtcaacatacaaatagttctctgtacgtagtttgtcaaaactctgtatgcctatcggtaattttcggacgatatttcccatagccttatctgtttaatttacacaaatgtaggtattttttccaaggaggcaaatagatcgaaaaaaacacgtacgtctttttccggaaacacgtacatgttttttgaaaaagacgtacatgtttttccggaaagtctttcgtacctttgcgggctgatacaaacaagaaggaaaatggattatatcgctcatacattgccgaatggacttcgcatggtacatctcccggttaattccccggtctcttactgcggtttcgccgtgaacgccggtacacgggatgagaacgaggatgaatttggcttggcgcatttcgttgaacacatgatcttcaaaggtacggagaaacggaaagcgtggcatatcctgaatcgtatggagaacgtaggaggggagttgaatgcctatactacgaaggaagagacctttgtttattccatttttatggaggaggattttggccgggcgtttgagctattgaccgatctggttttccattcccaattccccaaacaggagatcgagaaggaggtagatgtcatcttggatgagatcaattcgtatgaggatagtccttcggaacttatattcgacgagtttgagaacttgctttataagggtcatgccctcgggcataatatcttaggggatgagggatctcttcttcgctttgactccgagtccggtcgttctttcatgcgtcgtttctacgccccggagaatatggtgttcttctcgatgggacgaaaagacttcaagaatatcttgaaatcagcggaatccgctttaagcgatatctctttcccgatggctgaacggatccggaaagctccggaccccatcgaggcttgcgtacgccagatccataaagatacccatcaagcccatgtactgatcggtggccgggctttcagtatgcacgacaaaaaacgtatccctttgttcttgttgaacaatatcttaggtggtccgggcatgaataaccgcttgaatgtctccttgcgggaaaagcatggcttggtctataacgtagaatccaatataacctcttataccgataccggactagccagtatctatttcgggacagacccgaagaaccgtgagaaagcgatgcgtttggtgcataaggaattggcccgtttacgtgacgtaaagctgtccgccactcaattagccgccgccaagaagcaggtaatcggtcaactgggcgtgtcgggcgataaccgggagggtcttttccttggcttaggaaaaagctacctccattacaaccgttacgacaccctccctgaagtattcgcccagatcgagaaaataaccgccgggcaaatcctagacgtggcgaatgaggtgttcgctccggaacggttgttttgcttgatttatgagtgaggctaattatggaacctatacccaacccccaacatcaagttattcggattatgaaatttgtgcagttggtatccgacatgcaggaataaatttcgtgtaaccgataccttgagggctaggatctggtataatcctttcaggtcgcccttgttgtaaaataaattatgtccgactcctatattgatcgagaagaatggcatggtgaattcgccacgggcagagaggccgataccgatttgctcatggaggggcgggcggtagaatcggggttcttcgccgacttggatgatctcgtcggaataaatatttgcgctttcgtcatattggccgtctagggagatacctgcttttaggaaccggttgaatttgtacatcgggttgaggttgaatccgaggatgccgaactgacctggaaaaatatgggcctcatcacctagcataacccccttagcacgggtcgcaccatataggatgacatcgtaactgacacgttgccaaaagctggagaggtataattgatttgccggtaaggaacgtgcggtacctatctcatgatggctttcctcgataggattgagcgtgtagacgagtccgatccggccaccaatcgtattcaatcccgcattcggaagatgagtatttccgtttgagtagtgcgttaaatccgccccgacaagcaggttgcaataacgggatagtttcgcgttgaggaaaaagcccagattgatataggcattgatcttagaaccgatgatcttattgcggtaattattgttatcatcatacggatgccaaccaaatgaggctccgaaattccactcataatcgaaggatagccgggaagaaattttggcgatgcgggagctttggaaaacatacgccgcccaaggattaccaacttcctgccggtttccaaaggtattataagagacgcctattccttggtaagtgtgcggataaagctggccctccttagagttaggattcagttggaatccgtatttcaaatggaatgaagccgccttacgtaaagtaagcccgtttccatagccgtcatctttgaggaatttactagtaggggcgacatacgagggacgtacgtcgaatcctattttgtggataatggatttatcatcatcttgagcttttaccgtacaggtccatatcatcatgaccgctatgtaaaagcttatcatcttgctttttatcatacttcaatacgtttgtctgatcaccaacactgcgctttgtctttcaactcgggtatcttgttcttatcgaatacagggcttttaatacccgctttcttttgggctacgtaatcctgtaataataggaacgcttgacggctcaacaatgagatcgcgatcaaattgcagatcgtcatcagtcccatggtcacgtccgctaggctccaagccaagtctaaactagccaacgcaccgaacatgaccattccaccgactaatatacgataaataaataagacacttctcttggacgtgataaaacgaatattcgcttctccgtaatagtaattaccgataatactactgaacgcgaataaaaggatcgctaaagcgacaaacgtactaccgatgctacccacctcgttactcaaagcttgttgcgtgagctggactccattgatggagccgtctaatggcgctccgctaaacaagatgatgaacgccgtgcaggtacagataatcagcgtgtcggtaaatacgcctaatgcttggatcaatccttgtttgactggatgggagacatgcgccgtagccgctacattcggtgccgatcccataccggcctcattactgaatagacctcgtttaatcccttgcatcaacgccgctccgacactaccgcctatcgcctgttcccaaccaaaagcgtttgacagaatggtttctataacagcgggtaggcgggtaatattaaacagtacgattcccaacgccaatgctatatatcctaatgccatgaccggtacgacaatactgcttactcttgcgatgcgctgaatacctccgaatatgacgattaacgtaagtaccgtaagaatcgctccgatccaagcatgatcgatgccaaaagcgccttcccaagctgcgcagatcgtattgctttgtacggaattaaaggcaaagccaaaggttatcgaaatcaatacggcaaataatacccccatccatcgtaaccccaaaccatgtagcatatagtaagcgggaccgccaatgaacgagtctttccctttttctttatataattgagctaacgtagactccacgaatgcgctggaagaaccaagtaaagcgatcagccacatccagaatacggatccgggtccgccgatcgctacggctgtcgctacaccggctaggtttccggtccctacacggctggctaaagatacggcgaaggcttggaaagaggagatatgcttttcccctttttctcctttcccggcagaatcgcctaataatcggatcatctcgccaatcatgcggaattgcacgaacctactttttatcgtaaaccatacggcgcatcccaataacatgataataaggatgtatgaccataatatatcgttgactccgttgatccaattattcaatagctccatgatttataatctgttgtttggttacaaagatacgtatctacgaagcaaattcatcgaaatattatttttttatcattttcttgtaacgttttccaaacggctgtcgtcttatagttagaaacaaatgataagcgggaaaggccaccctgctatattcggaaaaaatacgataaaaatgaaacggatgatgatttggatcatactgctaggcggtatggtacagggagcttttgctcagaacttggagataaagggaatggtgcgggacgctcgcaacaaagaaatcttggaatttgcaaatgtggtattgcaaacaatggactcttcttttgtagcgggtacgactacggatatgaaggggcattttttattaaataagattaaaaaagggagttatattctatctgtctctagtctaggctttaagacggagtatatttccttggaaggcttgtccaagaatatttctttgggagaaatatccttaaatgatgatgcggtatccttagacggggtgacggttagcgcctctgcccagacgagccatgccgataaaaaagtggtcttcccatcggatcgccagatgaaggcttcgggaaacggtatggatttgttgcagcagatgatgctaccgagagtgcaggtggatttgttgaacaacgagatcaaggccacgggaaatggggtagtccaagtgcgtatcaatggcgtgaaggtggaacaggatgagatcaaggccttgaatccctcggatatcatccgtatagaatatcatgataacccgggcttacgttacggcaatgccgatatcgtgctggattatattgttcgccggccggatacgggaggtagttttggtctggacatggcgcaaggtatcaattccatgtggggtgaacataatgcttggggaaagatcaatcataagaactcggaatggggcgcttcttatcggatcggtcctcgtgatttctatggaatgaaacggaataacgaggaagagttccatttagcgaatggaacgaccttgaaccgtgtggaaataggcgaaccttcgcgcgctcgtttgttcatgcataacctgaatgtgaactatagctatcaaaagccggataagtatatgtttaacgccacgttccgctaccggaataatcatcaaccgcattgggattatcaaggagtcttgatgaataaggcgaatccggaggataaagtggatatgatcgatctatcgggatcagcctatcaagctcctgcgctggatttatattaccaacgggatttgaagcataaccagaccttggtgtttaacgtggtagggacttataaccaaacgaaatcgacccgtatctatcaagagagtaaacatgaacaattgttgactgatgtaaataatgtggtggatggtgataaatactcgattatcggcgaggctatctatgagaagaaattaacgaatggtaatcggttgagcggcggtttacgccataaccaatctttctcggataacagttatatcaatgggcataactataagacgcatatggaacagatggagagttccgtatatgcggagttcaagggaaaggtgaaaaaactggattactcgttgggtgtgaccgtgaatcgctcgtcttatagtcaacggggtgaggatgcggattatgaacgttatacggtgagtccccggttgaccttgttttatgctttgcccggggagtcttccatccgtttgaaatcaacgatggggaatgtgactccttctttgggtgagttgagtgcgattgaccaagtgatcgattccttgcaaatacagcggggtaatcccaacctgaagtcttatatgagttattatacggaattgaattacgagtttcgcaaaggtctgttttacgtgaatgccttgggcgcttatgagtatcagccggacgctatcatggacgagaaatatctggaaggaaataagatcatccagacttgggataatcagaaaaactggcaacgggttgtcgcgtctgccaatttgcgggtcggtccgatcaaggacatcttgcaattttctgtcaatggtggtatgaaccattatatgagtaacggtaatacctacacgcatcgatatacgaactggtggtgcgaggcgaatgtttccgctacatggaagaaatggtcgctttggtatatggtaatgacaaattggaactggtttaagggcgagacgatgagtgggggtgagaatatccaaggaattcaactcggttatcggcataaggacttgatggttggcctgcgtgtcatcaatccgtttacggataattataagcaggagacggagaactggaaccaatacgcctctttccgccgttcaaattatatcaaggaaagttctcgcttattcatcgcgacgatctcctataatttctccttcggccgtaagttcagcgccggccagaagaaggtgaataacgctgataatgactccggtgtgatgagtaccggtaagtaagggaatattttatatctttgaggaaaaataaaatgagatatgaaagcgattaatccgaatgagatcaaagacaactttatcgagttgattggtaaggagtggatgctggtaagcgccggtgataaggagaagtttaatatgatgactgccagttggggcggcgtgggagtgttatggaaccgtccggtggtgtttgcctttattcgtccggagcgttatacccgtgagtttatcgatgctaggaatgaattcacgattactttcctaggaccggagcaccggaaagcccatagcatttgtggctctaaatccggacgggagattgataaagtggccgctacggggttgacgccgctctttacggaggccggcaacccggtattcgaggaagctcgccttacgttggaatgcaaagtggtctataagtccgagatcgaggaggccaagtttttagatcctaccgttttccctcgttggtatgatgagaagaacggtaatgcgcatatcgtttacattgccgagatcttgaatgcttgggagaaataatatcacccaagcagttctttcatcatttgctccgtatgcgtgaggaaatatttagtgagttggtaatgctcggtttcctcatacggggtgacatgcgctccggtatcatcgatggcgtaaatgtctgcgttcggataagccatcaggatcggggaatgcgtggagataatcagttggcaaccgttattcaccagttcgtggatacgcactaaaagggccagctgccgttgtggggagagtgcggcttccggttcgtctaatataaataatgtattgcggctggcataattcagaaaagcgcagagaaagctctcgccgtgcgattgctccaataaactcctgccaccgtaagctttataggcgtagatccggctgtacttacgtaattccagttgggcttgcctatccaattcggccgcatggttaaaaaaggattctgcccggaagaagaaatgcttttccggtttttgggtctcgatcagtttaatatgctcgggtaagacattggcgtaaatcttgtatgcctcggttccgtcatatagcatacccggttcttcctcatccctttcctcatatttactcatcatcgcttccagcagggtggattttcccgccccgttctccccgacaaggaaagtgaccggcttgcggaaaatgaatgattccgtgaaacgtactgccggagctttataaggatactttagctcctcgggatcgccggctaccaagtccgggtccagtaattttacttgcttcagatagatcatacagaatatgttttgttacaaacatagtgaaaatatcaatggaatgaaagataatatcgtaatcgttgttgttcgtgctccggaaactcttccaatagggataaatcctcccaaccttgtaatttcccttttttccggatcattttttcgatgatcctagcttgtttataactgacatatgggtgactggctagttttttagctgacagttggttgacaaatagatgactaataactgacgggtccacggaaaaccacgatttcatcgcttcataacgatcctcgtcaataccatatacttctcctagttgttctacggaataaaatcctcctaataagtccctgtatttaatgatccgcttggcaaaaacgctaccaattcccggaaccattttaagggcggtggtatcagccgagtttaattcgacaaccgttccttgcggccatttttctgctttgggataagagggaaaatggggctttgattcccttcggatgcgtttggatttccattcggaagggattttagtttcgttcgaatgggattctttttctttccgaatggaatttgaaggtgttttattcgaatagatccgtgaggaatcttgtttgattccggtgtttgccaatgggactgtttgaaattgggaacggtagaaatccgtcccgataattgcgatccatgccatcgctattaaggaaaggagtagggtaagagcctgcctttcccccttggagaaataaagtaaatcacgccatttcatagtcttatgttttgatttgtggaacttccaccgacaaaggtagaagttccgtttctattgacaaggaattctcggtattatttaccggtaatccatttcaagatccctaattcgttcaaaaatacgataccgatggcgattggggccacgtatttcataaagaatacgtaagcgccgaaaagacggaacttaagagtcccctcattggtcaactcggctttcaatacttttttatcgacacgtgtacctacgaaaatacaagtgagcatacctcccagcggtagcatgatcttggcggtcaagtaatccagcgcgtcgaaaaaggccaagcctccaatcgtgaatcctttcatcaccccgaatgagagtgaactgaaaatacctaagaaaaagactcctaaggaaacgatcaaagccgctttcttgcgtgtcatatggaactcctcaagaacgtaggccgtagctacctcatgtaaagagatcgtggaagtcagtgccgccatcgctagcaagatataaaaaatacaggaccacaagccactcagcggtaattgcccaaatacgttcggtaacgtgataaacacgagttccgcaccagcggaaggggtgatgccgaaactgaataccgccgggaatatcatgataccggccaatacggcgacaagcgtattaatgattgtcacctgccaagcggtggcctgcatattcgtatctttcccgaagtaagaggagtaagtgatcaggcagcccatacccaaactcaaagagaagaaagcctgtcctagtgcgcttaagaccactgaggaagtcaatttgctaaagtctggcttgaaaaggaaaagcaatccggcctcagcgttcggtaaggtcacggaacgtacgcacatgatcagcaagatcaagaataaaagcggcatcatgatcttagaggcccgttcgatacctttttctacacccgagacaatcacgaagtgagttaacccgataaaagcgcccatccaaaagatcggacggaagacattggaggcgaaatcctgaaaatcggccgtatagtctatatccggctgtccatacaaacggccacttagcgtttgccaaacatattcaagcgtccaaccggagacaaccgagtaataacttaatatcaaaaatgcggccaagatcccgttgtacccgatccagcaccattttgttccgggagccatcttcttgaaagaacccaccgtattactacgggaataccggccaatgaaaaactcggttaccatcaccggaatgcccaagaatatcatgaaaagtatgtagaccagtaggaaggccgcacctccgttcgctcccagcatatacgggaagcgccatacgcttcccaatccgacggcgcatcctacggtagctagtactacgcccaatttactaccgaatgtgactcgattgtttgccatattatttattgttgcttttatgcttttaattgttacctattttcttattttcgggagcaaaagtaataatttgaattaatttgttcgtgtaaagtataaataatttagtgaaaggagtatgaaacgaggacgtaagaaaaagttagcaatctcattgatggattatatgggaaaacgaagagacatgaaacggcagttaaagaaagaagggacagctgagttgtatgaggtggccgtaaggcattttttaagattcgtgaagaacccggggttctgtttggccgatttgaatcgtgcgttggtgatagatttcatcacgtatcttcagggaaaaggattagctactaatacggtaaatacgtatatcagtagtttgcgggcgctttataatatggcttgccaagagtcgttggttcctgcgtcatattatccgtttgagaatttgaaactccggcgtgcgatgacggcgaggcgtgcgattcccgcatctttgttccagcaaatcgctcagatcaaggtggtggatgacccgcaagtggaattatcgatagatctttccctattcagttttatggcttgcgggatgccttttgtggatatagcgtacttgacgaggcagaatatccgggggaatgagttggtatatcaccgtcataagacaggacgtatgatccggttggagataaccagtagtatgttgcaattgatccggaaatacgcggatcggcagcgagcgaccggatcgtcgtatttgttcccgattcttccgcccgggaatccggaccatttgaggtataagcgtagcttggctcggcataatgcccggctgaaacggattgggcaaactttacggttaccgaatccgtttacgtcgtatgttgttcgccatagctgggcatcagaagctttacgttgcgatatgccgatggccttgatcagccaggcgttggggcactcgtcggagaaaacgactcgtttttatctggaagaattggatatatcacgtttggctcatgcgaacatgaaggtgataggctctgtaaatcggattttagagaaaaggatggatggtttgtgaacttatttatggaataaggtttagcgtttcaaaaacgtcagcggagaataaacgttaaacaacattttattgtcgtttatatagtatatcaatagaccacacggaacgtttcagaaaaacatgtacatgttttcctgaaaagacgtacatgttttttggaaaacacgtacatgaaatccaataaatattatggtgtttctatacagctgccaatcaatggcttacatataggcctatccaaacgagcttattgtattatttgtttttgatattcaggaggaatttgtagagtatagaaattcctctttagttgagagagtgaatcaataaaggtgaatatggttcattttaaagacatagcttcccctaaattccttattgggctactgccacgtttaatttgggggctgaagtttatctcgcccgtcattggacacttgagttggaggcaggcttgaatccgttcagcggcaagaacgatgatgggagttatggccgttcactgaagcatttgcgtctgcacccggagttgaggtattggttttgcgagacgtttaacggtcatttcctcggcgtgcatactccgtacctattatataatgtagccgatatcaaatggctgggtacagagggcgagcgtcaccagggatggggcgcgggagccggtatcagttatggatactcgtggctgctgtctcgccattggaacttggaggccacggtgggcgtgggctatctgtacttgaagtcggacaagtatccctgcgcgaattgcggtcgcaagcaagaagggatcaagaagcattacttcgggcctacgcaggcggcgatcaatctgatttaccaattttaaatcgatggaggactgaaaaatgaagaatctacaaggatggatgatacttgggatcgcctgtttggccggttgtgtgggtactacgattcccgtacaggcgcagcagacggctaccgccatcgtcgtgaaggagcggttggtggagcatgtgggcgatcgcttgataattgatatgaaactagcgctggatgagttgtcgctatcggccaaccggagtttggtctgtacgccgctgatcgagcggggcgatagcgtaagggctttgcctcccgtgatcgtgaacgggcgtaaccgccagatccagtacgaccggtctgggcgcgatgcgacggcgaacggagagtttgtcttacgccgtcacaatgggaaggagcagacgttcgattaccatgcctctattcctttcgccaagtggatggagcgttcggaggtgtcgctggtagccgatttttgcggttgcggttgggaggcgttgagtaatgacaagtcgccgcttttcccgatccgaatcgcggagcctgtggtattgcggccgcttttggcctacgtcacgccggaggcggagcgtgtgaaagagcgtgtgaaggaaggaagcgccttcctcgacttcccggtaaaccgcacggagatatatcctgagtatcgcgacaatccctcggagctgcgcaagatccttgagaccgtgtcgtcagtgaaggaggatccttacgctaccatcacggaggtatatatcaagggtttcgcatcgccggaaggtacctataagcataacacttatttggccgagcatcgcgccaaggcgttgatcgaatatgtgaagggcctttaccactttgagcaggcccgtttcacggtggatttcgagccggaggactgggccggattggagaaacgggtggagaactcctcgcttgcggacaaggaggagttgctggccatcatccgtgcggacgagccgaaggattacgaccgccgcgaggcgaagctaaaggcgttgaacgggggggcctcgtatcgggtgctcttgcgcgatatttatccagccttgcgccattcggattacgcggtgcgctacacgatccgttcgtttacggtagaagaggcccgtgagttgatctattcggaccctaggcagttgagtctaaacgagatgttccgggtggcgcagacgatggaaccgggtagcgacgcttaccgcgaggtgttcgagattgccgtgcgtatgtatccggaggatccggtgtcgaatctgaacgccgcccttacggcgatcgacgcgggtcgcttggaatcggcccgccgttatttggcgaagacttccaattccgcggagcgtaccttggcggaggcggccatcgccatgctggagaaccgcttggacgaggcggaggccctgctgggtaagttgtcggacaatccttccatggcctcgcaggtggaggagaacttgaggcagatcgcagagaaacggcaagagtaaaaataggataagataacagacaaaaattttaatattatgaaaaagaaaaaatggtacgtagcgatggcaacggcacttttattggcggccggttgttccgatgatctcgacaacggaaaaaataacaccggggcggaagaggatggcgagaaggtctatatgacggtgaacgtctctacggtttcgcaaggaacgctaacgaaagcagatactactccttctaatcctaatcaggggggagccggttggggcgaggatggtaatggttctcttggtgagctttccggctctaaggagggtatggtatatgatgttaatatattcttggtgccaacagatgaagagtctttgggggatggcaatcagctagagttactaaatactgacaatggtagtagtatacagatcgcaggccaaggttattattcgaatctggaaggtattgatgcgagtttaggtggaactgagcctggtcatggtgacggaaaggttacgatgaaagtaaccatgaagaatcctctgacacaagataagagcaattatcaggtatttgccgttattaatgcgggaggaaggttgactggtattagtacgttggcagacttgcgcgatagagttgccgcaaacgatagggcattgtggactcctgctagtaatatggcggagtaccatcattttgtaatgtctacacataagatgataagtggtgctattccttctaacggcagttctatcgttgaactttctgctgcgaatatggatgagacatatccggctcggacaacggtgttcgtagaacgtttagccgctcgtattgatttggcatactcctcgaatttagatctgactaatataccgggaacttctcctgtaaagaataagggtacgttcacgttgaagaggtataaggtagtgaatcagtggaagggcgaaagttatctttttaagcaagtttctcctacggtacagtataactatggtgctaatgcggtattgccggcagatggtaccaacgatcctgttcgatatttaggtgatgagaaatggatatggaagaataatgacactggtgccggatcgtacaattatgtgttagatccgaagatccgggaaaagaaattgccggaaggggaaagttcttcttgggatcaatttaaagattcatatgttaattattttaatccgagcaattcaactgatttgaataacttggataagatggtgtctatgcctacttctggattaagctatacacaggaagtaagtggtgatagtcggacatattacccggttgtttataccaaggaaaatacgttggatctgaactcgcaggtacatggctatactactggtgtaatcttcgagtctgaatttactccgagtaacgactttaaggtgagttcctatgaaaatggggagatcaagtctgtgaatttgcctaatggtgataaaacgtttctttccgcggctcattataatagtaatggttctgtgtcacgtcttgtttataaagatgtgaagagcgttgccgcccgtgcgttcaatttggaaaacgacaagaaaaatttattgaaaggctttatggatggttgggacgatataactgcggatgtcaatgctgtgaagaaggcggttcaagatatgtcttctcaaaatggattagaaagcgcgtttaaggaatatttggatgggattttgactggtaaagcaactcttgatgaggatcttaaacagaaattgacttatgcggcttttaggagacaagcttcgcatcttccttctaatattacccctgtatctcaattcagctcagagcagatcggcaatttataccaatactataatgtttccctatacaaaagcggaagaagctatcacaagttttggatccgtcataacgataacggaaacgatggtctgatgggcgtgatggaattctgtatcgtacgcaataacgtgtaccagttgtatgtgaaaggtattcgtggcttgggcgatccgttaccttataccccgggtaaggatgatcccggtacgccggatgagagtgatgatgtcactatcgacgtgactatctacgtgaaggattgggtaaaacgtacgaacaaagacattatcctataactttacccttcgggggattcttacgatgggcattgtaagcactttatgctgcccatccaagcaaccttacgatgcccatcataaaaaccttataatgggcatcatggtttacctccatctccggtagtacgggcggaggattactgtgtatcttaataaaatgattatgaaccgtttatttcatacctgcaaacagttgattggcatagccgccttgtccgtggagctatacgcttgcgattggatacacgacgactcgctgccgctttgcgagttccgcctgtatttcaagtacgactataatatgaaattcgccgacgctttccagcatgaggtagacttcgttacgctcttcgtctgcgaccaagaagggaacttccttttccagcggcggatcgagaagagcgagctggacgagcggaactccatcgccttcgacatggagccgggtacctatcaggtagtcacttgggccgggctggacaagggcagttacgcatggaacgaccctgccgagacgtcgcaggctgtcgagagggcgcaaggcgtcaaggtacgtaccttgcgtgaggacgatacgacacaacccaacgaactgcacccgctttggcatagcctcgataccttcaccgtgacgcgcgacatgcccgaggccgacaccatctcactcgccaagaataccaacaagctgcgggtcgtgctgcaaaacgtgatgggtgaggacatggacgtgaacaacttctccttccggatcgtggccgacaacgggtatatggattacgacaattccctgctgcaagatcccaccatccactacctgccttattatacggagaacgtggagttgggagccgacccgacccccggcgctaccgtaggcgggcaatacgtggccgtggccgagatgaacaccatgcgcctgatggcgggccgtaactaccgcctcatcatccgtcatcacggatgggagaaggatgtgctgaacgtgaacctcaacgattacctccttctcaccaagatggaggggcaccgtatctccccgcaggagtatctggaccggcaggacgagtattctatcatcttcttccttacaccgaaggtatgccccgattgtccggataagcctacgcctccggatccttcgggacctgacaatcctgataatcctgacaatcctgataacccggataatcccgatggtcccgatccggaagaccctacgatcgtggggtacgcctgcttcaagatacaggtgaaggattgggtgattcgtatcaacgatggcatattgtaaacagagatttattaaatatcgctaatgatgagacgctataccatatataaccgattgacggcggtcgccgctggtctttgcctctgttggctttttatggcttgtggtgaagaccgggggggcgatctcccggatgacgacccgaaccattgtgttgtaactatcactttgcggacatcccgttcggtacgcccgccgcagacgaaggccggagggatgatgacgaaggcggatgaaactactgagacggatttctgggcaaaagatgaagaatacgagcgagacatcacgaactggctggtggtggcctatgatgagaatgcggattttgccggatatatatccggcaaagatggaacatggactccggatatcagtaatgaggattctcgtactacggtggagatgaaactaccctttggcacataccatttttatgcgttcgccaatttacaatcgttggaagacggtacatcgttgtatcaaaaaattaccgaagcccattccttggcggaactgtcggaggtgaagatattggactcgggaacgagtattgatacaaggaatgaggagaaaaaaggtaaattcggaggcgaggaagcgtctcgaaagcgtattcctatgagcagctacgcccaaaagcatacggtattgcccgctccggcagagaacaaattcgagattcccttgatccgcatgatcggcaaggtgcaagtggagataaccaataacttagataaatccataaccgtaaaccaattggacatcatgaacctccgcaagggaagcctgccgatctggctcttgccttggggaaatgagaattatttggagtttaaggataacaaggacttggaagagcctttggctccatcttttccgaaagatgcgaatcctcctgtagtaagtctagaggatctttatactgaatctatcaaacccggtgataatgaaaaagaaatacaagccaaacctgtggacggcgagaacggtagtaaacgagcttatattcgctacattcctgagaccaatgcagccgtcggagagaacggcggtggcatccacctcggtgtagagatcgaaggccgccctcgtacggagcacctcacgggcttcgacttcgtacgccgcaatgacctgctggtcatccctgtcttgataaccaacatcacgacgaatttggaagtagccgagcaacgcctccccatcggggtctacccgaccgccttggtctatggtgagaagacgggcgtgcaaatactgacgcctgttgagcataccttgcaagccgccggcgacttgtcgatccgtttcgagatatctagcatagaaggcgtgacaggagatttcacgatcaaaggtctcccgcaggagggaacggttacggaaacagcgaaaatcagttcgatccaagtaaaaagcgacgagaaacgtctcattacggccgtaaacggagaggattgtgacaagaaacagcgtttctaccttcccgaggcttcgatcaaggaaggaaagaaaggttccttcacgatccgcactcgggaactgggtggaaacgtggatgctacagtcatcctcacgctcattataaactattatgtgggtcaggagaagcaagagatgcaaatcccctacaccatcaagatcagaaactacaaataacaaccataatataacaacaataaactaaaaaaggaggacctgacggatgaaaccatcaatcaacctacgatataaatccttgttattaacttgcttgttaattttttccgctggtgtggctgtgccggcgtgggggcagacgtacacgatcaattataagaatggttcaccccaaaccggtattaccgaacgtgtggatacggtgtatgtggcagatggggaagagagggagttgtttattcctgagttgaggaataatgatggcttttataatgcgaactatcggtggtatgtacgttggtatcagcttaatgaaggtaatttaagttgcgaaaatataaaaggtaaggctataaatcctaagttagatggttcttttgtacagggtggtgccttacaggatcttataaatctctatccaagctcgttgagagacgcaggtacttctttatttttttataaagacttttataagatagaaggtacaactgctataaatagctctgtccctctcggagcctctacggttgaatattcagcggtgaatgtaaaagaagatcttgttgtttgtgatgtgagtttaaataacaattataaggtggatgggactacattcactgaacctactttgtccatacgttataaatttgtgattcgtccggcaagcgaaattgcgaatcgcataaaagattctaaagcggatgaaaccactccttttatggatgaaaccatatatgtcccgcaaaataatggaacgattaatatacaattgggtaggatcgctaataattatgcgtggtatgacggagatcaaatagtacagggagaaacttatcaatataagaaagacaatggcgaatggaaagatttgggtaatcgctggacacagattataaataatttgataacggttggaacacaacctgtaaaattagaaattcgggcggtgggtaaagataagacgaaagcgagtcctctgttggtgcgatataatcttatccctggtgatcatggtttcatgttacaggaaaagcaagaaaaagattctgacccaaggcgtaatccggataactatccggagttttatgaaagaataggatatataaattttgaccggaatgattcgatatctgtagacgatttgaactctgttaataatatggcaaagattggtttttctgataataaagaggataaaggtaaatggttggatccggagatcacgggatatgctccatttaattatcaaattcaaccaaataaggataatcggattcagaccttacaaaaccaatatggtttgtttcgaacagcggatgtggaaaaagtatcaacgaataatgaaaaggttgagggaaagacttatttttggtttgcaagtgcccaaagtaagcccaaagtggcaatctatgaccggacttattacaatacggggaaaaaatcattgggatatttcttttatgtggatgcggccaatttgccgggacgtttggtgaaaattccgttggatggtaatatctgtgcgcatacgggtattttagtgaacttttgggtgaatgatatgacgacatggaaagatactcaagccgaaggaaaacctctacctcctaatgtaaacatgaattttatcggattaaaagcagatggtacagaagttgttttacatcgttttacttcaggggatgcactgactgattatacctcgacttcggaagggcggccggctaataacaatattggtaaatggcagcaattaatgtactcattttccttgtcacaatcgcttgatgattatgtaggatattatctggaggtacaaaacaatacagctcattcatatggtgcggactacgccatcgatggtctgcgtatttatcgctccataccgcaaatcgacgtaaagcgagtagacgtgtgttcttctgccagcctgaccgttgccacggattacgaacttctgctcaagaatatgggttggagcattaatccggatgtattgtccgatctgaatatggggaatagcataacggaagattcaaagcatatatggaaataccgctatggtttgatgggtggagatccaaggaaaagaaatgagaatcttaataaaacgatcggaaatgtttatattggagctaccgataaaaaggaaaatggggatataaagaagcctgaagattggattacattaaatacggatttgaaggattatagtaatgagcgctataacaaccgaagcaaggtgtatcgtattatcgttccgactaaagaagggttgaagcatcaaggatttgaggatctgacaaatcatgaaactgcgatgcgacgacaaattgtcgtaaacctgcgtatgatcaatgatttcttatatgatgccgctgagcataaaatttggcaaaaagacatactagatcatgcccaaaaaacaaatggggataaattcccggaagaagagtatattgcgtacttgaaacaaaatttgagtgtactctgtggcaaatcggattcagagtgggactataagattccggaaccgaaagacctatctaaccagatagatagaataatggaggggaatgacaataatctgtacgaagaactgatacgggccgtttgttcggtaatgggtatttctcgtcctcgtgtgccttggtgggatgaaggaaatagcaataccatccatttgagtgccattgatgtggacaagactgagttgaaatataaaggggagcaaaatttcggaagtaaagagaatgccgcctccggtaggtatgatgtggtaatctttagtgcggccgcgacagttactagtgatgaaatcgtgaatttcccgaatgcccatgcgggagatagtttcaacgatccttgcttgctgactacccctttcaccgtactcccttccttcacgatcgtggcaaagaccaagacagatttgccggagggcatgatcgcttgcgagggacggatcagtcatattgaggaggcaaccatgtgggttgaaagatatgatgagaacaacaacttgatgaccggagagacagataagtttgtagataaatatgagggttattcatatacgttcgactggttcttgggagactcgctggaatttgctgcgttctatgatgaatatggattcgctttagaagatatattgaagtcttatagaaatacccttcccgatggcgagaaagcttcgtctttccccgcgaaaaatttgattgagtattatgaaaaattagacgcatataaagataagcctgggcttattgcgaaattgaagacattgcttttaggtgatgtagatacagagccgaaattggtgattggcgggaaattgggatatgcggagtttcgttgggtaaaaaaagtggtagcgattccttatctaccggagagtattcccgaggaggacagactttggcttttctgcgatagacctcaagaacgatcactggaagccgctcccgccccgaaactacttgttggtttcccggacgtgaagtatccggaaggaatggagcattatcccaatgttcccctgcgtattggcttgccgaatatcatggagaaaagcataaccgatattcctatccaaagcaatggcctaaagatgggtatgacagaatccaatcaattaggtctgcccgaaagcaatactacggatatcttcttgcggcaaggggctacttatacaaaggtgggtaatttgacaaagttgtctgcgaaagctaaaagtgaaaatgaggcaggtgaaactgactatggcggtggattattctccatgacttttgacgataaagcttatacaaattttgacgaaggccagatttatgccctctatatcccattcggtgaatataaggacgaagctttcgtaaaaggctcttgcgaaggatacgctaccttacttatcaagatcgtgccggaatatctgacttggaagggtacgaacaccggtgaggacgctgaggcatggtataatgacgcaaactggcatcagtctacgaaaggggaattgtacatagatccaaacggagaagataaaacagacgccaatggcaatgatgcagacttgaccgccgccttcgccccgcttcatttcacccgtatcacgatcccggaaaagcagatgctggaattggaaggcttggagacgaaagatcatttgttacagattcccgaagcgaactcatcaaaggctaccgagtatatccaatatgatatggcggtagacaaagacggagataatacgatcgtaaccccgtactatataaataaggtaaaggctatctatttcaaacccgaggcgcagttacgccgtcagcaattcctgacgtacgacactgcccatgtggaattcgagatgacacctgacgcgaaatattggatggcatcgcccctgcaaagcgtattcgccggcgatatgtacaccgtgaagaacacgggccgtcagaacacctatgctttcgccgatatcacctacagcacggctgacaacgaccgccaagccccagccttctaccagaaagcttgggacaaggcgatcacgatgtacgtgccgaagagcgaagcagatcaaatagtttcttttccggagaatggtttggatacaactcattacgaggtagtccaatccaactggagccgtgaatataacgatgtgaatgtgccctacgctttaggaaagggattctatgccagcgtagaaaagaagaatgcgaccggcttaggtgagaaagtattggtacgcctgccgaaagcggatgactcctacaaatatgaaccgtggaaaccggatacgaaaagcgctacattgagagccgccatgaccaaagccccgactttagcaaatcggatcaatgctggtaaactggcagataacaagtcgatcaaggtggtattgacagatgtgaatggaacggaagattggtggaatacggataatggaaccgtccgtgttattgctgatggtgacggcaagcacttcctgttgggtaatccttatatgtatccgttggatatcgttcgtttcttgaaagagaatgaggctatcttagagcaaaaatattggacattggatgtgaaggaggggcttgttgtcggtacacctgatgtggcatgggaaggtggaaatgttactgatgctacatccggagccgttatcgcctccatgcaagccttcttcgtagagctgaaagatgcggctcaaacgaaagcggaaggtacggcaaccggtaccgatctgaaggtggttcatttcgatccctccatgatgcaaggagagtcggagaaggtctcttcttccttacgtaccgctacggccaaaaaaccggtattgaggctgacagcagagcgggatgcatatcgtagcacggccttgttgacgcggcaggatgatgccgcgaatagctatgaggcagataaggatgccgtaatcttgctggatacggaactggaggagatcccgcaggtgtacactatcgccgggactcgtgccgtgggtgtgaacgtagtacgacggatcgaccaagtgccccttggcgtatatgccggcgagggtaagggggaggttacactgacgatagagggtatcggcgattgggcggagacgctttacctgtacgatgccgtgacccgtaaaagtacggagttgtcggacaatacgtataccttgcgtttggacggcagcagccatggacgttacttcctaagtgcgggctcgcctaccggtaatgagggggtggacaacgtagaatctatctctgtctattccgccgtatcgggtaggatagtggccagtgctagcgaggcgttgaagcggatacaggtgtttacgccgatgggtcgtttggtacgtaccttatatcccgcccgtccgacttatacgttcgatctcccggcaggcatctacattatccgcacggagatcgcccacgaccaaaagacggtgaaactacgggtattgtaaataaacccccttgttgttagttcgtttctaccactccatccttgatatggatcacccgatccgtgtttgtggccagctgttcgtcatgcgtcacgatgacgaacgtctggttcatctggtctcttaactcgaaaaagagggcgtgcaattcttccttgttcttggtatcgaggcttcccgaaggttcgtcggcgaggataaccgccgggttattgataagcgcacgggctaccgctacccgttgcttttctccgccggatagctcggcgggcttgtgtgccatacgatcggagagtttcaagaagtccagcatctctttcgcccgcttctcggctatggccgatttctccttggcgatcagggctgggatcatcacgttttccaaggccgtgaactccggcaataattgatggaactggaagacgaagccgatattccggttgcggaaagccgccaattccttatcgcccaatcgtcttgtctccgtgccattgataaccagtcgcccgctatccggtgcgtcgagcgtgccgatgatttgcaacaaggttgtcttacccgccccgctggggcctacgatagcgacaacctcgcccttgtttatcgtgaggtcgatgcctttcaatacttgtaaggcaccgaaacttttcgttattccttcggtttgtatcatatcaagtttcttaggacgtgcgaggcaaggaaacaaccgaacgttgccggcatataagagaccgttcccgtggtcgtacgtttacatgtttcgttttcaacttcgatcacggcgtccggatcggcgaactcggtggaaaatacgacgggaatccccttgcttacgcctagaggacgcaaccgtttccgcaccgctttcgcgagggcgcaattgattgtcttggagatatccgctatccgtaccaaggatgggtctaccttagcgcccgcccccatggaggacacgatggggatcttatggatatatgcttggtacatcaggtataccttgggacttagggaatcgatggcatctaccacgaaatcgagaggggccgataagagtacctcctccgtccgttcgtctcgcaggaattcattcaggacggttagttgcaactggggattgatatcaagcaaacgcttggccacgacctcggctttcggcatccctagggtggaatgaagggcgggcaattggcggttgatattactctcgtttaccgtatcggcgtctatgatcgtcatctttcctactccggcccgacaaatctgctcggcggcataagctcccacacctcctaggccaactaccaatacatggctacgggataagcgctccatatgctccgctccgaacaaaagttccgtccgtgtattccaattgtaactcatttatctatttttgagcacaaaagtaatcaattgttccggttcctccaatacttgcttttatccgaaagctttgtgtcttgttactgcacgggcgttgcagcgttactgtatgggcgttgcagtattactgcatcagccttgcagtaccaccgcaacccaggttgcagtggatgagttacgtcagatgggttgaatatgaaagactgatcctccgtcggaggccagcggaagggtgattttatccctgtaggtgatctcctcaacctcttttacgagtttgttcgagtctatattcgtatcttcagcatctttatagatcgttatcttatatttcttgtccttatccaagaacttgaggtctacatcgatactgcgtgcttggctgttattgatcgtaccgacaaaccaatcctctccctttttgcgggcgatcgttacgtattcattgacggaagcgttcggaacgactgtttggtcccaagtcgtaggcacggctttcaggaactcgaatcccggttgtccttcgtaagcctccggcgtatcgcaaatcatgccgagatagctctctaataccacgtacatcgctaacatatggcagcgggtactcattacgtaagggttacgttcttggttcttgaacttatcccttggcaaagagcggaaacctcctaaatgataatcagtcgctcccgctaataaacgggtaaaaggcatatggatgtcatgatctgcgtcggtatccttatcccatttgcaatgctcgtaattaagcgtaccctcgcgggtgaactcgttgggataggtacggctcaatccagacggcttgcaagctccgtggaattgcacgaatagatgatgcttagccgccttcgccaagaactcttcttggatgcggatcatctcctgatcgtctcgatccatgaaatcgatcatcatgccggcgattccccatttctcgaattgggcgaaagcctcgtctatctttgcgtacagaggtttccagttggtccataaatggatacgtacgccttgactcttggcgtaatcgcaaatctcctgcatattgaggctcggaacgactttcaagatgtccgctttaggacccggagaaccgaatccggctccatcctcgtcataccaagcttgctcggcgttcccgtagatcgagtgataatccaatccgttacgggctacgaaatcaatgtaatatttattcgtggggaaattgtttccgccaaggaaagtcgtatccggaacgacatttccgttccaccacgtaaaagtagtcttacccggcttaatccaagacgtatcctctatcttacaaggctcattgagattcgtaaggatattggacgctatcaaggaaccgatttgatcactgatcatcaagacccgccaaggagattgatggggtagggatgcctctaccttgatacgctcttgtcccagtttaggtgatagtttcccgagaagagtcccgttttctttccataggtacataccggcgtagtcacgaaccgccgcctcggtaatcgccatataaacatggttcgggaaagagaatagggcgggcatatccatcaatcgtttattatccatgtcggcataatctgtgaccgtatatttaccttcgtgggaactttggtagttggggaggaataaagtagttacgttcggattcccttgtaggttgaaggtggttccctcgtcatacatgatatacgaatcccatcctttttgcttcggaaactcatagcggaaggcgataccgtcatcgaaagccctcaagaccagattaatcttgcgaaaaggctgaacggtttcctctagcgggatgattacctctttggaaaggctatgtatatgtttcgccttaccaacgatcaattcgtaggtctcttccttcgtactgaacacgggtttgttgatctttacattttccccgaacgccccattatcgaaagtcaacgttagcggagagtcttggatcagggtttgtttattaaacgctacgctgtataccgggctattcttatccaaaaccaaggagaacttgatctttccgtttggagaagacaatcgcacgcttttatttgcgtataaagagtgagcgcaaagtataaaaaatgccagaatgaggtagattgattcttttttcatggatgataattttataggccaaagatatacatatttattttgtacggtttaactgcttcaacaattctttaaggctgacggtctcattcttgaccaatggttttgcccaataggaaatactcaagatatagcccagcgtgataaataggaaaaacatggaatagcgcaacccgatcagatctccaagtccaccaatgatgaacggaatcaatgccccaccgaaaatacccgtacacaagataccggaaaaagccccatgatgcttatccacggagttaagggctaaggcgaatatcaccgaaaacatgatcgagatcgagaagccgcaacaagcgaaagcgataatcgctacttgcgtaggaccgaagagcgctatcgataaattaaggatcgctatcatcgagaaaatacgtaacatcagctttgagtcgattaactttacgatcaccaatcccaacaagcagccgatggacatcaatccccagaaccaagcaaccgtagtagccccggctccttccgggctgaccccatgatacatattcaggaaaagactcatccaattcgccaatccttgctcggttcccacataagcgataatccccaagaaatagaatataacttgtttttgcttgagtaattctttataattctgtaccgttcccgccttctcatcttcctttaattctactttcgggaatttgacataagagataaccactaacatgatgacaaaaacaatcgtaaagataaaatagagcgagctccaaggtaagctctccggcgttatccctttgaggaaacggatgaagaagtcgttcgccggatcctcaccggttaatttccgcataagcccggccaagacgaacgggctcatgaaagaagcggccccgaatacgatctgggccaatacctgattaaaggcatattttttctctccgcccgcctcacgcatcaagggcaatataatcacctgtagcatcgccatgcccagaccgatagcgaaaagggaggtcaatacgatagggtaggtcgggaacatgacgaaaagccccgcacccaaaaacgtcagactgaaagcgaccaataaggaaatctttcccccgaaacgctcgatgatcattcctgccgggatggacatgatgccatatgccaagaaaaacgagaacggcaagaatgcggccaatgtcaggctcagcccaaaactatcgataatcatcggtagcatagggcctaatatattggtaacaaaagaaatgacaaaccaaatacacaagatgaggagtacgatccaattattcttattcatgatagatagattcaatgattaaacaccaatgccgccgccccgaggcatccggccttatttcctaatcgggcaagttcgatagtcgtgaagtacgaggtttccttcatcacgaatttccagacctgttcccgtatattattaatgtagaaatctccggattccgaaatgcctccgccgataatcaccttttgcggagcgaaaatgttgataaggctcgctacgcctagggacagattccggaaatgatcctccatagcgagtacggcctctttctcttgagctttatagcgctctactatatattttccatcgatacgggaaggtatctcccgtccgttcttctccaataattgccgatataaggcgatcaacgcacttacggaagcgtgtgcctctaggcaaccggacgctccgcaagtacattgattcccattcagaccatgaataattaagtgcccaagttcggtgccccggttccggtagccgccataaagccggccgttcaagaacaaggcgccccctatgccggtacccaccgtcaagaaaacgatatcggagaggcccttagccgccccatatatcacctcgcccaaccccataaggtttgcgtcgttgtcgatgaataccggtagattaaattccgctaacgcaagatccaattgttggttgtccagttcaggaagattattggcaaagagaaccacccccttatctactacggaaggtacacctatgccaattccgtaaatcccccagtcccgggaacgggcgtagtctgtcattttccgtacgatactttttatgatatcggataatgggcgtggattctcttttgattgtgtggtttccgacgattcgtaaagaatgtcgccattctggttcacaagagtatattttatgcttgttcctccaatgtctaatgcgatagcgtatttcatgataattgtaaaagcttaattagaactatgcgccgcttccctgtcgatcaggcaaatcacgttcgggtgcagccacaataaggaggccggcaactccgtcgagatcttctgttcaaggaaagcttgagtaatctcccttttctttatcccgttgataagaaggataatcaggcgtgactgaaagatattcgccatgcccaatgtcagtccgtatcccggtttttccgtatccccggcgatcatgggatgttgcaatgatttctgggacagatgagccacatggcaattcgtatgtaaggaaggagccggctcgttcaaggcgatatggccgttcatccctattcctaatatacaaatgtcgatagggcctttttgatccagtatctgttggatccgctcacattccgcctcagggttctccggatcgctttggaacgctatataccggtcttccgggatttgaagcggacctacgaaatagttccgtagatacgactcgcacgtacccgggtggtccatcgggattcctccccattcatcaagctttagtaccgtgaattgggagaataattccggttggcgaccggcttcctctaccagcaactcatacatccgggtaggagagcccccagtggcggcacaaagcgtaagtgccttgtgctgccctaactctgaggtaacaatctcttttgccttaaggcttaatgcctcataagattgacaaatctctattctcatacgattttagagctctttgattcggatattgcggaaacaaacaccataaccgtggtcttgcataccgatgtaacccggttgttttccgcattgtagcatcaagtcgtaagcttccgggcatttctccggactcgtgctgaacttgctgaacttactatgatccactaacgcgcgccataccggtgtaccgaactggaattccagcactttcacgtcgttcatgtaatggatcacgcgttggttatagacaacgattctcgtcttgttccagtttccgtacggttttacgggttgtggatccggcataatcatgtcatatacggcaccggcctgacggttaccatcgcaaccttcccatgcgtccggcatattctcgttgtcgagtaactgatattctgggctggagtaataaataggtgtaccctcaatttcttgcgcagtatagaagataccgctattaccggccttgtcgatcttccattcgatctcgaaaacgaaatttttgaacttcttgtcgtagatcaagtcgccgaagcccgtgtctgccttattgtcgctacctttataggtgatcgatccgtcttcaaccacccaaccttggggtacatcctgacggcaatagccgcgccatccgttcaaggttttcccgtcgaacatggtgatccactcgcctcccgtagggataccatcgctatcgagggcttgggtttgggcggtttgcgttccggcattgttcgtattgttattgttgccagaggtacatgatagagccgatgcgaataaggctacggccataatactgctataaatctttttcatctttgtatagttatttaagtaaattatctagttgtagagacggggtgtgccccgtctcatcccattgttgttcgcttttataacttgagatcttcccatccatcgcggtatttccgcttgatgaattggttcgcttgctcgaagttggtgatacgcatgttcgctccgtcccactggaaagttttgtttcttcccggatagataaagccctcgcgttctccgtagatcgagtcgttatgtttcacttgttcccggatattatagctgcgtaagatcaggttacccatcaatacggtctccgtcaacggaccggcgtaaccttcgaatggtgattctacgtccgccttgtcgtatcctgcgatacaagagtcgatccacgcccagtaatgaccgttcgtgccgccttcgatacgtttgtatttatgaggaatgttcacgtccttgtcgaacagcggtttcttgttcgccttctgtccctttggccagaatctcgggtcggaaccgccccagccgcaagaagccatacctttcgtacctacgaatacggttgcgccttctacgtccatcatatccaagtctcccatcgtgcaggtcatgtctgcatccggatcgatctcctcgaaacgctccggcatgataccaccgtccatccaatagagattcaggtcgcttccgtctttcttcttgaatttataacggatcgagctggctaccgggcaactctcaggataataagcctcctcgaagataccggagtagacattggtcgtgctgcaagaaacctcagtcggataacctaattgaagcaatttgaatggagggccgatgatgtggcaacccatatctccaagagcgcctgtaccgaaacgccaccaaccacgccagttgaacggaacaagattatcgatataatccacatactcggcggtacctacccataagtcccaatttaattccttgggaacctcaggcttctggctcggccaaggaataccttgcggccatacaggacggttggtccagcaatataccttctggatgtcacctaacagatctgcctcgaaccattcacgaagggtacgcataccgtcgcaagagttaccttggtcgcccatttgggtcacgaccttgtatttcttggcggcctcggtaaggatacgtgcctcgtaaatatcgtgcgcgatcggtttttgcagatatacgtgcttacccatccgcatagcgccgaaagcttggatcgcatggttatgatccggggtggagatacatacggcatcgaagttcttgccttccttgtcgtacatctcacggaagtcgttgaaatacttcgccttcgggtatttcttacgagcgtcggcagactgacggtcgtctacgtcgcacagacaggtgatcgctgcgtttttgtgcggcgtattcatcaagctacccaaatcggcggctcccataccgccacagcctattttcgcgatataaagcttatcgctgggagctacgtgtcctaatcccgctacggtaaaactgggcaggatcgtaagggcggcagcacctgtggctgccatcccaaggaattcccttctcgagattccagtcggacaggattgtttatttacctctttcataaatttgttcatattatgattaataattgaattggggtctaaagaattgatattaaaaacagactgatatgattagaatgccggatatcccgggttctgaaccaaattattattcttctgccaagccttgaacgggatcgggaagatcttacgatattccggagtctgtttcggcttcatatatctcggtttcagataagtcccgaagcggatcatatcttggcggcggacaaattcgaatgccaactcataaccacgctcgttatagatatcgtccaatgtcacgctcgtgtaattatgatcggaattgccgtaagccctttcccggatagcgtttaccagacgagtagcttcaccgagatccccgcccatacgaaccaaggcttccgctttcatcaggtatacatcggccagacggaagatagcgatatcgttctccatattggtattttgcatgcctttctcatatacccacttattgatacgtgcgccgtcttcttggtgaacctcgccccacggggttaagttaccatccgcatcggttttctcagttcccggtaccacatttaagtcgatcgtatggatcaagtcatgtcctagggtcgttttcaaaatctctcccgtgctagggtcgatcatcgggccaatcaagaacgaaccttcgtaacgaggatcttccgtatcaaatgtgcggacaaaatccggctgggcgttgataccattccacataccgccggtgaaacctaatacatcgggatccagataatgcaatgtccaaagatgaatggagttaccccaagcatcagatgccttgtagcagatcgggaaaataatctctcgtgatacctcgttatgaacctcgaaattggttttccaattcggctcgatgatatattcgagtttcatgatctcgtcgcactgctccactacacctttccagttcggctcgccgatccattcctcggcgttgaggtacatctttgccaataccatacgggcagccccttgcgtgaacttaccgtagctggcgtctgatacatcggagcgtaggttcgggatgatctcggttaattccttcaccacgtatttatacagatccgcacggctcgtgatggagggcaaggaggtatcctcaaaatctgtcactaatggagcgttaccgaaaatatctacgattacataataccagaaagcgcgtaatcctcttagctcagacaagtattgaagcttaagttcatcgctcatcgcctcgcttttctctataatattatatacggaattaactgtggttaaaccttccgtacaatatgtccagcaattctctacggagtaagagttcggtttccaactgtgcatacattgttccatgtattgtccgccgtcccaccagtcgccacctacacgtgtcggtgctatcaagatatcggctgtcatatcggccgctccccaaggaccgtcataagccagcatgttctttagggattggtatgccggagccatgatcgcattaatctgcttttctgttgtcccgaattcgtcggtaggaagcttgtcgtatacgttctcgtccaaatccatgcaagagacaagtgctaccggagcgagtacggcacatattatatttttgaataatcttttcatgatcgttactgtttgtgtattagaaattcaagtttaatccaacagagaatgtgcgtgccttcggataaaattcacgaggttctacacccggggtcaaaccgtctcctgaatccataggaacttcgggatcaagacctttatatttcgtgataacgaataggttttgcgccgtgaaataaacacggataccattcaatgctttgatcttataacctaaagtcaagttgtcgagacgcataaaagaacctttctctaagtaatagttggagaatcttggagtttcgcttaacgtataggtcaatggatcatccaatgcgtttgttcccggcaagaatccggattgagcgtatgccatgcgggtcgcgttcaatatatcattaccgatcgttccacgcaagaagaatgacaaatcaaaattcttgtagcggaaagtattggtgataccatatgtcagtttcggttgagcggatccgatgtagtcataatccgccggatcggaaatctcgccgtcaccgtctttatctaccatgatatatctgccgttctcatcgataccgttgcaaaccaagccatagaattgtccgatagggcgtccctcttccaatacgtgtgtaccgctggagcttccaccccggatgaatacgtcacctaataagatcttatccattgtaaatacgtcgttggatagacgagtcacttcattctcattatgagccaagtttaaggagatgttccaatcgaaatccttcgtgcggatagcgtctgcgttcaaactcaactcgatacccgtattacgcatatcgcccacgttagccatgatctcgctatataggtaaggaggggttggcaccggataggtataaagcatgtcagaggtctttttgttataccattcgatacgaccacctaggcggctatccaatacggagaaatcaagtccgatgttcaacatcgctgtctgttcccattttaagtctgggtttgcgttttggctgattttataagaaggtagccaagaaccggtatcataatatacaccatctgtgccgtaaagctcgagggttttgtaggggtccaatcctgtttgattaccagtgataccataaccgacacttaactttaagtcgttaagccagtttactttttccatgaatgactcttgggtgatattccaacccacggaaacggaagggaaggtaccccatttgttattcgttccaaatttagaagaaccatcccggcgtacggtagctgtcaacatatatttctcattgaagctataattggctcttgcgtataaagagatcaggcgactttgccatttttgagactctgcgtctcccggattcagattttgtcccgcggctaaattgttagcacctaataaatcagtgacgaaaccacgggtctgtacgtgagtctcctcataattctcttcttcccaagagtaaccgatcaaggcattgatcttatgcttattgaactcagctgaataattggcggtccattccatcaagtctttatcacgtagtctggaccaacgttcggccttaccgccatcgttgtaaccggcttgagactcgatactgttgtatttgctctcatcttccgtattccggcttttagctaaaagaactttagcctctaagccatcgataatcgtataaccgacatcagcggttccatagaaattattgatgcggttcttatgtgtattctctttctggttacgtaccgggtttccttggtcgtattcacgtgtgtcgaaccaagatccatcctctagcttaaccgggcgaacgggaatcatattgtaggcaagtaagaaattggtcgcattggtcggcgcgttatctgtaacggtagccacgccggtgatgcttactttcaaacgatcctccagagcacgttgggagaattggaaacgggcgttgtaacggttcatggagttatcgcgtgcgataccttcacgttgcatataagaaagggaacctctatagttatggtgtgaaccacctcctgataaagacacggcatgatcctgttggaaaccgattctcgtgatctcgtcgaaccaatccgtgttcgctcccatgtcaaaatccttaccgtccttacccggggtagaggaagtatagctacgccattggtccgctgttagcagattcggcttgttagccaaggtagatacaccgaacgctccattataagcgatggtcggtttgctggcgtaacctttcttagtcgtgataaggataacaccatccgctgaacgggaaccgtagatagcggctgaagaggcatctttcaagatagagatagattcgatgtcctgcggattaaccgtagacatgtccatgcccggcacgttatcgataacgattaacgggccttggtcgttttgcaaagtggatagacctcttaattgaatcgtcgagttgcccgttacgtcgccggaacctgtattgatcgttaaaccggccaccttaccttgcaacaaatccgctgcgttacgagtcagaccttggttgaaatcctcagcggtcacgttggtgatagaaccggtaatctcacgtttcgtctgcgtaccgtaacccactacgactacctcatccagtttttgagtgtcctctttcaagtttacattgatctcgtttttgccgcctaccggttgcaactgtgtcatgtaaccgatataggagaactcaagggtcgcgtttgaggatacttccataacgtatttaccatccagatctgtaatcgtgccgttggtcgtgcctttctcgactacgttagcaccgataatagcgtttccttccgggtctttaacgacaccggtgatgcgtttcttagtctgttgggcaacaatgtttttattaaatacattgatatttcgtccttcgatcgaatatttcaaactcgtgttgcgtagtgcttgcgataagatattttctatggacttatcggttgcgttcacgctcacttttacgttctttacgtcagaatccacatagaagaataagaaatcgctttgtttttctataatagcgaatagatcggttagcggggcttgatccgtcttcacggaaatcgttacagattgtgaataggaattagtcgctaccgcttggaacagtgtcaagaaaagtaaaataaaggacatttttaggaccgagagcattttttttaagtctttggacctaaaagacctataatacgaaacattttccatatttttgtactgataaaaggttgataatatgcgtctgccacaaaatttggtcgtggagtagcagaagcaggaattaattctttttaatggggccggctgtatttttgcagccggttttgtttttttgaaagataggatccgtgttatctcataggcattgcttgttttttaagatgtgttgatatttttattttattgaatatagtaagttccatctctttgtgaccatttgatcggcaaactacgagagatcacttgtaaaatctcctttaaagattgatcctcactgaatgttccggatacagtgacattcgggtccagcaatctcttgttttctatatggatcggaatctcgtatcttttctcaagctcattcagcaaggtacaaagcgcaatcgatttatactttagcaagccgtctttccatgccagattttcttttgcgttgacggattggatatcaatcttgttcgttgaacggatgaatgtaagttgctggtcgggagcgagtaagacttgttgtgtcgggctttcgaaacggatagacccttccagcaggacggccgtgatctgatccttccctttatcggcttttacactaaaggtcgtacctaatacccgtatggaggcatttcccatatcgacgatgaaaggtctttccggatttttcgccacctcgaaataggcttctccttccaaattaacctttcgctgatccgtaccgtatgcgtcagagtaggtaaagcgactattccggttcaaaatgatcttcgtaccatcatctagcgtaaaatgagatttatttttatcggttatataggtatagaattgctgaaccttagcttcccgggtatttaagtgtattgttgcgaaaaacagaacaagaaaggcgattgccgccgcaatgggagtagcgatgaaacggatcagcctcaatctcttttgcctgctttgatcgtcgatcttctttctcaaattatcgagggacacattaggcattaaggaatggctgaacgagacttccgcatcccaataactctttagcaaccgaaattcttttttgttcttttcgtctgcgttcagccattcgctcagcgaaagaaaatcttccgaggagctgttgccacttaatatccttgtgataatatgatctatgctattctccattttaagttgtttctatactaatagtcgcaaccaaatttgaaaacccttagtgggagcatggattttttacttatttttttcgtagctcatacacgagttctttgtattcggagattgcgttgaatgaggggcattgtttgatccattcatccggcgagatcgtcccgtctccgtttaagtcctccgagagatcccggtgcccacagacccatgagccgggaaagcagattaagagatgccggatcaaacgtaacaacgaggtcttttgagcctgtgtgcgggtatcccgtgactgtccggtgatgtccagtccaccctcgtagcaaatcccgatgctgtgtttgttgtgtcctctcgcatgagccggaatttgctctagcgggcgcaggttcaccacttctcccgatttacggatgtagaagttgtaaccggcacggaggaatccccgtgccttgtggtcactctccagttgctccgggctataatccgtattctcacgggttgccgagcaatgaatcatgatcaggtcaatttttctcatatctcgtccgggctttcgctatcagaacctgcgctctttttcgtaacctccagaggctcgaaattcacctcattgcgggtagtccgcagggccgagcccgggaaaaagataatacgtaccccctttatcttggtggcgtcgaagtcctcgggagtattcgttccttcggagttaatagacatacggaagttaccaaattctcccaattgcaccacgttgccggaggacagttccagatccatcgcccagtttaatgaatcgagcaccgctttcacgtccgccgacgaaagcgtggagcgagagcaaatcagtttacataatttgttgaggtccgaagtccccgacgttttagcgatcgcgtagttctttactgagtctttctctgcgccgttcaataccttacgctttactactttaaatttcactgccataattttaaattttaaaaggttaattactaatgacaatgcaaagatagaccctctgaaaaacgggaatcggcgagtgtcggtgagtgtcgggatatgtaagtagtagtcggtttacttgttattctggttttttattacgtaatttgcgttacgtgaattgcgaaacgcagataagatgctgaatatgaataatccttttttaatagttggttatcaaggtccagaatatttttgtgatcgggagaaagagacagaagtgattttatccgctcttcataatgggagaaatatcacgttggtaagccggataacctctcgcaatctacgctgaaggagattttcgactacttgcggcagtctggaagagaatgttatctggctattgacgagttccagtaaatcatggaatatcctgagaaaggggtggaaggcctattgcgttcttatattcaatttttgccgaatgttcattttatcttttcggggagtaaaaagcacttgatggaatatatattcttctcaatcaagcgccccttctatcaatccaccccaaaattatttttagacaagatcagcaaggaggtgtatttttcctttgcccattctttcttcgagaaggaagggaaggagcttccggaagaaatatttgataaggtgtacacatgggtagatgggcatacttggtatgtgcaatatcttttgaaccgtctcttcgctttaccggaaaaaacactttctccggagcttcttgattctctcatgatggagatcctacaggaagaagaatatacctaccagacttatttccaattgttgacatttaatcaaacccagctattgaaagcgatcgccaaggaagggatcgtccgggaggtcaatgctgccgccttcatcaaaaagtatgatttgaaggcggtgagtaacgtgaatacttccttaaggatattaatagataaggagtttatattgaggcaaccggatgggtatatcgtgtatgataggttcatgtctatttggctcagccggatatgacaacggatgaaaaatatttagttgacacagttcgctcgtaccaccaaaaattattccattaatattatgatgggattatcttcttctgccaatttctggagatcttccctatgcaatagttcgttaagttttgaattaacaaataaaaagtaggtcaagtcctcccgattcattatattaagggtttccacatcctgaaaaaatgaatctgaacgaacttgaccaatatttagagctaataaatagtgtgctgcttaaatcagcggtaaagctaaacaaatggcgtgagaagtttatgcttgaagtcctacttttatatttgattatccccgggcggattaatttccttcaaccgggtcgttatggtcgctttggtgaacaacgctatcggactttcatgcctgcttccacccggaagtggttcaaacaccgccgataaaaacaccggagcaagttacatacacattaatagactggtatctacatgtgccgtgtacacgcaaggaaacacttcagcgactggcaaactatgtggttgcggatgcctacttctccaaatccacctttgtgtatggcgcatttgaaatgggatttcatgtaatcagccgatttagagatgacgcctatttccgttatctcatcacggaagagcctacaggtaaaagagggcggcctaaattatatgacgggaaaatcgagatggagcacttggaagaggacagatttgaaatcgtcaatttggagaatgggcaaggacgtattctttcagcggtagtgcattcacgttcattgaataggaatatacggttgtgcattcactttttgttctttaagtgcccggttgtcaatagcatctcaatgggatagggttggtatctcaaagggataggtttgtaaagtcaatgggatagaggtgttgtctcaatggctttgcggccgtgtcccattggcttttttgtatcccgtatcagggatgttgctgataggttagggctcaaagggcgcatctttatgtatgtttctaaaactttttctgtaaataacgtttatacccctcttgtctgtagagtgatgtaaatattatttttctaaaaatgtttctttgaaagcgtaaagatgcgccttttgcgccctaggatttttaccggggaattttcctgatgccttaacatgtggatatacagttgtttgtgtggttcttccctcttcggctttttgggtctttggggggcgatataatgggtccttacccacgtttacgtgatccgaaagcactaaaaccaagtgcatttcgcatgatttcatgagctaaaagccgttttttctgtgtgatttcctatcggggccaagatgatgttcatcgtttttattacgtgcgaatgtactcgtggagcacttgtttcaagtgcgtgtggtgacacgttaggccacgtggtgggccacatgagccaagaatggatatcgacgtattattaacgtatgcgatccccctcgtgaaaaaaaacttgaaaaataatgcccgataaatttggaccgtatgttttatagcattacttttgcacccgcattcgagagagaacggcgcttcagaaatgatggaaacgtggaggtatccttgggtaggggatgaggttggctaggccaagcgataatttccaaccgcccggagatcggcttgagaaaaaaaacttgaaaatttttcaccgaaaaatttggaggttaagaaaaagtccttacctttgcagccgcaatcgagaaacgatagcgagagggttctttgagagatttacataattcaacaagtagtacaagtattaggagaagaaattttccggatcgataccgtcaatagagtatgactttggactacgataaacggattccggagcgaggatatgataaaacaatttaaacaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactgggaggcttgagtatgtttgaggcaggcggaatgcgtggtgtagcggtgaaatgcttagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattttgacagctctggaaacagagcctctagcaatagcgatttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtagccgtaccggaaggtgcggctggaacacctcctttctggagcttcaggattccgtaccgaggtcatacgaggtattgatcgccttgtgctgctgttgagattatgtttatatatagatcttacagaccgggaggccggtcggagagaaaaagatgacgctgggacgtaagtcttggcaaagttgacagtcctatagctcagttggttagagcgctacactgataatgtagaggtcggcagttcaactctgcctgggactactccgaatgagggggattagctcagctggctagagcatctgccttgcacgcagagggtcaacggttcgaatccgttattctccacagtttattgagagggataggcatcagccaatcccgtcccgacgacagtcgggctcagtaagaaggatctttgacatgttggacatcaaaaagaagaaacaagtagagcgagcttaagatatatcaacccgtgcgtcaagtacgaggtgggagaaagtaagcaagggcagacggtggatgccttggctctcggaggcgacgaaggacgtgataagctgcgaaaagcccgggggaggcgcaaatagcccttgatcccgggatatccgaatggggcaacccggcaggctgaaggcctgccatcccgtaagggaggcgaacgtggggaactgaaacatctaagtacccataggaggagaaaataaacaatgattccgtaagtagtggcgagcgaacacggaagagcccaaacccatgtcgtctaggcgacacgggggttgtaggaccacgacgtggcaagatagagtcaagtggaacgccttggaaaaggcggtcatagagggtgaaaaccccgtacacgactgacgattgaagcctagtggcatcctgagtagcgcggggcacgagaaatcttgcgtgaaacagcggggcccatcccgtaaggctaaatactcccgagagaccgatagcgaaccagtaccgtgagggaaaggtgaaaagaaccccgagcaggggagtgaaatagaccctgaacccgtctgcctacaagcggtcggagcgtcgtaatgacgtgacggcgtgccttttgcataatgaacctacgagttaccttccccggcaaggttaagttcttgaggaacggagccgaagcgaaagcgagtctgaacagggcgccaagtcgggggggtagacgcgaaaccgagtgatctacccttggccaggttgaaggttgggtaacaccaactggaggaccggatgggtaagcgttgaaaagctttccaatgagctgagggtaggggtgaaaggctaatcaaactcggagatagctcgtactccccgaaatgcatttaggtgcagcctctttatagtatatcgtgaggtagagcgactgattggatgcgagggcttcaccgcctatcaagtccagataaactccgaatgcgcgatatatatttacagggagtgagggcgcgggtgctaaggtccgtgtccgagaggagaagaatccagaccaccggctaaggcccccaaatgatcgttaagttgaactaacgaggtcggatcgcagagacagctaggatgttggcttggaagcagccattcatttaaagagtgcgtaacagctcactagtcgagcgatctggcgtggataataatcgggcataaacgatctgccgaagccgtggatgtcgcaagacatggtaggggagcattccatgcggcgtcgaagatgagggatgacccttgttggagcgcatggaaaagcaaatgtaggtatgagtaacgataaggggggcgagaaacccccccgccgaaagaccaaggtttcctgatcaacgctaatcggatcagggtgagtcgggacctaaggcaaagccgaacggcgccgccgatggaagaatgggttaatattcccatactgcctcatggagtgacgtggagacggagaagtgacagtcctgccggctgacggaatagccggttgaagggtgtaggtgtcgatcgcggtaggcaaatccgccgcgagagccgaacctgacagtatacggagcgcttgcgcgacgtaatatggacgtaaccatgctcccaagaaaatccgctaaacttatccatgcggcacccgtaccgtaaacggacacacgtggtcgggttgagaatactgaggcgctcgagtgattcacggttaaggaactaggcaaattgaccctgtaacttcgggataaagggtcctcgtcgtaaggcgaggcgcagagaataggtccaggcaactgtttaacaaaaacacatggctgtgctaaatggaaacatgatgtatacagcctgacacctgcccggtgccggaaggttaagaggagatgtcatccgcgaggagaagcgttgaattgaagccccggtaaacggcggccgtaactataacggtcctaaggtagcgaaattccttgtcgggtaagttccgacctgcacgaatggtgtaatgatctggacactgtctcaaccgtgagctcggtgaaattgtagtatcggtgaagatgccgattacccgcgatgggacgaaaagaccccgtgaacctttactatagctttacattgagtttgggcagacgatgtgtaggataggccggaggcattgaagcaggtacgccagtatttgtggagccgacgttgaaatacggcccttcggttgtttgagttctaactcctagttaggaggacactgtatggtgggtagtttgactggggtggtcgcctccaaaagcgtaacggaggcttctaaaggtgccctcagaccgattggtaaccggtcgcagagtgtaatggcataagggcgcttgactgggagacatacaagtcgatcaggtaggaaactagagcatagtgatccggtggttccgcatggaagggccatcgctcaaaggataaaaggtactccggggataacaggctgatcattcccaagagctcatatcgacggaatggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcaggagatttgcgaggctctgacactagtacgagaggaccgtgtcggacgtaccactggtttaccggttgtcccgccaggggcaccgccgggtatctaagtacggatcggataagtgctgaaagcatctaagtacgaagccggcctcaagattagatctccctcaagggtggttatagacgatgaccttgataggccacaggtgtaagggcggcgacgtccgagccgagtggtactaatagcccgggactttcctcacagtgaaggttgatatattttaagacgataaggcgaagctggtctcttcggattgatgtccggtcaaaatcttgataatgatattaaggtggctatagcacgagggatccacctcttcccattccgaacagagaagttaagcctcgtcacgccgatggtactgcgtaacagtggaagagtaggtagccgccgtcttaggtgaaaggagtcagtcgaaagattggctcctttttttggtatatacaccagccgttgtagagatgtggcacgctacgtctttacaaagagggaacgtggatagattagtcgtttatttctttagctagagattcccgtagtttccgtactgccgtggcgatgtgggcttctaatgtctttactgatatttctaggatatttgccgcatccttatatttcatcttatcttcacggatcagtttaaaagccatcttgcatttatccgggagcgtattgatcgcctcatttaaatgatcgatgcattctttagaaataagttcttcctcgggcgtagtatcggtatgtgcgaataaatcgatcgtattctcatcgatctggactttctccatatgttgtgtccggtataggctgatggctttgtggcgggctatgccatagatataagaatcgaagttagagatctccggtaatgactttctattattccaaagacttagaaatgtatcagagacaatttcctcagcttctacagaggaaggcacataaagggatgtaaaccgcattagcctctgaaaataggctaaataaagcgatttaaaagcagtttgagaatcggatagtgcgatttcacagacccattgcattatttctttggagtgtttttccaagtaactagaatcttgttaacttatttcccttctaaatatatagtcgcaaatgtatataaaaacccttagtggatctctctcttaaaagagaaatacttgatgttaatttcaacctaatttcatatctggttgtttttgaatctaatccgcaggttgtaacatcattgtaatatgtatgtaacggatgcgaaataattgtttcagaactttgcgcaagaattataacaatcagtatggaaacattttatttgttcttggtcatatttttgtttgtattggccatcgtagatttatcggtcggtgttagtaatgacgccgtgaatttcttgaattcagctatcggcgcaagagccgcatcctttaaagttattatcgctatcgctgccgtgggagtctttgttggtgcggcgttatccaatggtatgatggatattgcccggcatggtatttatcaaccccagcatttttatttctcggagatcatgtgtatccttgcggccgttatgcttacggatgtggtgttactggatatttttaactcgttaggtatgccgacctcgacaacggtttccatggtgtttgagttggtgggtggaacggtagcgattgccttggtaaagatcgctagttcttcaggcgctttgcaattgggggatctgctgaatacagagaaggcttttaccgtgattctgggtatctttctttctgtggcgatcgcttttttctttggtgtgatcgtgcagtatctgtcccggatcttgttctcatttaattataagaaaagttctaaatattttattggtctgttcggaggtttagcggccacttccatcatttactttatgctgataaagggactgaagacaagttcttttatgacgggtgagttcaaggatatggtgtatgccaatacggggatgatcgttttgggatgtatggtattttttacgatcttgatgcaggtattgcattggttgaaggtgaatgtattcaaggtggtcattttgatgggtacgtttgccttggcgttggcttttgccgggaatgacttggtgaactttatcggagtccccttggctggctattcctcttatatggacttgatggcgcagggagggaccactaccacggatacatttttgatgacctccttgttgggaccggcccagacaccttggtatttcttggtggggtccgggatcgtgatggtaatcgccttggctacctccaaaaaggctcagaacgtggtgaagacttccttggatctgtctcgtcaatcggatggagaggagtctttcggtacatcgcctgtcgcacgggtattggtacggaattgcagtaatatatccgctacgatattaagtatcgtgcccactccggttaagaactggattgatagccgtttcgaccaaagcgagatgatcatggatgacaaggctagtttcgacttggtacgtgcctcggtgaacgtggttttgtccggattgctgatcgctttgggaacctccttgaaattgcctttatctacgacgtatgtggctttcatggtcgctatgggtacttcgttggcagaccgtgcttgggggcgtgagagcgccgtatatcgcatcacaggcgtattgtccgtgataggtggttggttcattacggcaggggctgcttttacgatctgtttcatcgtcgctcttttgatttattggggaggtattccagctttggtcgctatgattggtttggcgatctattcgttggttcgtagccacttcgcttataaggctaaattgcggaaagaggcattgaaggaggaggtgaattctacggtgtctaaacttcgtaaggctacggatacccgtgaggctttggccctgttccgcgagcatagccgtgaggaattacaatccgatctggattttacggcggaagtattcggtaaggcggtaaatggattcatgaatgagaacctccgtgagttgcgcaaggtcttgactgccgtggaagagaagaagattcacttgaagcaagtgaaacgtgtcggtacgcttggcgttacccaattggatcacgatatcgctgtggagaaggggctttattattatcaaggaaatgacttcgccagcgagatcatattcagtatccgtcgcttggcagaaccgatgaaagatcatatcgataataatttcagcccgttgagtccggtacagaaagatgattttggtaaggtatctgaacaaatcatctccttcttgagaaattgcgctactatgatccgtaaaaacgattatattggttttgaggagctgatcgctgagtcgattaccttgatgaaccaacttaccgccttgaagaaaggggagttgaagcgtatccaagggcagtccggcagcacgaaggtgagcatggtttatttgaacatggtacaagaggcccagaacgtggtttcttttacggcgaacctcttgaaggtgagtaggaagttccagaaggaataatcagtctctattatattgggatggtgggagacggggcatgccccgtctctactggtttatagggttagcatcttcttttctttgactaaatcactctcgtccatccgcagggatgggactgtacacatcttgataaaatctcctgtttggcaagtataatcatagtaggcctgttgttccggggtaaaatcttctttatcgatcagtccgcttttccggctcatgaattcatcgatctccgtgctttctgattccttgataagaaggattcggcgggcgatcgggttacgattataatcctgcccgatgtataatcctcgtaattggcggggattcttgaaaaatggtatttgcaggtatatcgttaccatcgtgaattggggcgcttggttctcgttcagcatgcaatggaaattctgaggatcgggcatgatcccgaatccccattgagcctctccataagcgctgatccgccctacacggacttgattatccgagggggagagtaggaagggttccatcttgaggcagtccgaggaggaagaaaggctgtaactggtatagattcctttgaaagcctctattttagaggcggagagccgtgtctcctccatcaattgcttggcgaaaggattatcttttaggctatccggttcggcgagctccatctggtctaggcgaaggatcatctcctctatatgggaaagcaaacgttttttcgacacgttattcactagggcgagcgccgagtccagcgcttcttccggcgggtaactcttgatgccctcgaaataattcggcaatacggtcgtatatagggaggacaatatgctgggagccatatcgatccagtcggctatctctttcatcttaaccccattgcttcgtagatattcgatctttcggtagaattcttgaagattgttcatgtgtttatattcttgatttaccttacaaaataagaggacatatgttgcgtttccgtttcatgaatgttacataaatatttctttataatttattgattcctagttgggtattaataatatacattcatgggttcagtaatatgtctgtaacatggcggctgtacttttgccttcgaaaataaaacgacagaagattatggacactgcgatacagacaaataaaacatcccggaggcgggtttccgatctcttcttcatcctatgggccggaggggccgctttgctttcttattccttggtatatatgttgcgtaagccttatacggctgccgctttcgaggatctggaggtattcaatatggactataaggtggcggttacgatcgtgcagatcttggggtacgtggtgtcgaagttcatgggaattaagttgatatcggagttgcggcgggaagagcgcttgcggttcatcttgatgtccgtggtgatggcggaactttcgttggtattcttcgggttgctctcggctccttataatatagcggcgatgttcttgaacgggctttcgctgggatgtatgtgggggattattttcagctttatagaaggacgtaggatgacggatgtcctcgctagtctgctgggcgtaagtatggtgatcagttccggtacggcaaagtctgtcggcttgtacgtaatggatacgtggcaggtcagcgagttctggatgcccgccttgatcggggcggtggcattgcctttgctagccttgttgggatatgcgctgaaccggcttccacagcctacggaggaggatatcgccttgaagtcggagcgggagaccttgaacgggcggcagcgttgggagctttttaagcatttcatgcctttcttgacgatgcttttcgtggcgaatatagcgatcgtggtattgcgggatatcaaggaggacttcttggtgaatatcatcgatatgtccggttactcgccttggttgttcacgcaaatagatagcgtggtgaccttgactatcttggcgatctttggtttgatggtgctcgtgaaagataattttaaggcgctttcagtcctgtacggtttgattattacgggcatgatggtcatggcgttcgtgtcgttcgggcaggagcggatgggattgagcccggtgacatggcttttcttgcagagcctttgcctgtatatggcttacttaaccttccagacgattttcttcgatcgcttcatcgcttgtttcaagatacggggaaacgtcggtttctttattgtcttaacagattttctggggtacacgggtacgatactggtattggtgctaaaggaattcgtgggtacgagattggactgggcggtattttataaccaacttgccggatatgtagggatcttttgctgcgccacttttgtcgcttccttcgtatatttgcggcaacgctatcgcaaggagaccgctttatgtggctgcgaggaaatagcaactcttgagcctaccgaaaacaatgtccttacgatcgcttaaacaagaaaattattaaatacgatacatacagaatatgaagaagatttcaggtgtcattatggattgggccggtacggccgtggattatggatgcttcgctccgttgaacgctttcctcaaggtattctcggaagagaaagggattgatatcacttaccggcaggcccgtgagccgatgggtctcttgaagatcgatcatatcaaggcgatcttgagcatgccggaggtgaacgagaagttccgtgccttgtataagagggactggaacaagagggacgtggatgagatgtacactagtttcgagaaacatttgttcgcttccttgaaggatttcaccactccgataccgggagtcttggagacgatggcgatgcttcgcgagcaaggtataaagatcggctctacgaccgggtacacggcgaagatgatggagattgtccgtcccggagccgaggccaaaggatatagggtagataatctggtgacaccgaacgaggtcccggccggtcgccccgccccgtatatgatctataagaatatgatagatttagcgattccttccgtagatcaagtggtgaaggtaggagatacgatcgctgatattaaggagggcgtgaacgccaaggtatggagcgtcggtatcgtgaccggtagcaacgagatgggcgtgagcgaggaggaatataacagccgtccggcggaagaatgggaatctctgaagaaagaggtgcgtgagcgtatgttggcggcgggggctcatttcgtcttggatacgatcgccgagctgcccgcttgcatcgagaagattaacaacaggaattaagcttgataaccgaatagaataaaacaatcatatgagaaactatttattattgacaccgggcccgttgagtacgtcgcagacggtgcgtgaggccatgcttcaagattggtgtacgtgggataaggattataacgagggtatcgttaccccgatccgtaaaggcttgctggcgatagcgggattggacggggatgagtacaccagtgtcctgctgcaaggtagcggaacgtattgtgtggaggctacgatcggggccgccgtgcgtccggaggataaattattgatcctcgctaacggtgcttatggcaaacgtatggcgcagatcgccgattattatcatatcaattacgtactggtctctttgcatgagacggaactggtaaccggcgaggtagcccgacgtgccttggaggaacatcccggtatcacgcatctctcaatggtacatagcgagaccacgaccggtttgttgaatccgattgaggaggtagccgaggtgatcaagggccgggggattacctttatcgtggatgcgatgagcagctttggcggtgtccctatcgacgtgaaaggtttaggtatcgacttcttggtcagtagtgcgaacaaatgtattcaaggagttcccggcttcggctttatcctcgcccaaaaagataaattgatggcgacgaaggggaatgcccgctcgctttccttagatatctatgcccagtgggaagcgatggagaaagggggaggcaaatggcgtttcacgtctccgacgcacgtggttcacgctttctaccaagccatgaaggaattgaacgaggaaggcggtatcacggctcgttataagagatatcaagagaatcaccagatattggtggaaggtatgcgtagattgggtttcaagaccttgctgcccgatgatgcccaagggcctattatcacttcgttcttatatccttccgcggatttcgatttcacctcgttctacgcacggctgaaggagaaaggcttcgtgatctatccgggtaagatctcggatgcggatacgttccgtatcggtaatatcggagatatcttcccgaaagatatggaagccttgatacaatcgattaaagagatccggtaattgatgcccgtaacgtaacgagtccttcggggcccatattgaacagcaaatccgctatactcagattggggaggaatccgaatttctcccggaatacttgataataaggttccgggcggaaggcgggatcttccccttcgtgtttcgggcggatcgtttcccggaaatcgttggctacctccgattcataatgctcggtgtagacgactgcgggttgcatatccaacaggtcacagactagacggcgcagttcctcgttgaagtcgaggaggaactcgtatttcttttcgtagaaaggagcgaagtcatcggcataatactcgaaaaacggactcatattgtaggccgataccaaagcgttccagtgtaggtgccgccagtttccgtggtcggagatacggatgtccttggtctggcatttcaaggtatctggcttgacgatggggatggatagggagagtgggccgttcgcggcggcgatggaacaacggttacgataggtttgcttcacgtaattctcggcggtctcgatacggacctccgggtattggagcatcttacaatattgttgtatggggcctagataggcggtcgctatatatacaggtcgcatgattaatgaacgggtttaaagattcgttgtttgtcggggctgtaccagcagagccaagcgttgccgacgatatggtcggccggtatgaaaccgagatggcgggaatctaccgcctcgttggtattatcggacagtacccaatagtagtcttgttggaaaaagaagaaattagtctcccgcccgtccagatataactttccgtcacggaaggaagctttaccatccgtctcccgcatgatgatctccttgcaggcggtgagcgaggcggcgtccagcgggtaagcccggtctttccgtgggacgatcaacatgtattcttgcatttgttccccgataaaatgacggtttatggcgtcgggcaattcctccctcaattgatattcctcgaaagccgtgaggctgagcatacagccgaaactttcctgcctgaaatccctaagtgggatgtccaacttctctaacgtctccaagaacgtctccttggcgctcagtgttatgaaataggaacagagggagcgaggagagcgggggattttatgcccgtttatcgtatatccgtccatgctgacccggatcgtatcgcccggcataccgatgcagcggctgatgaataagggagcatccgcggaatctcgagagagcgggctggtaaaaagcacgaccttgccccggacgggcttattcttccccggtattttattgactaggatataatcccctttatgcaaagcctcttccatagagtccgtggagatgcgataggactctatgcagaaaaggcgtatgagcatgacgatccccgaggctagcgcgaaagctgccagccatttcatgagaactatcaggaatcgttggattgtcataatacgaagttttcacctcttaatccggatgaacccagcggaacaggcggttccaacggataccaccgtcgaacaggctgcgatccttgtccaaggatagccaaaccaagatcggcttgccgacaatgtgatcctcgggtacgaaaccccatgagcggctatctgcgctattatggcggttatcgcccatcatccagtaataatcgtatttaaacgtataggaagtctcgggcttgccgttgatgtagaccttgctgtccttcacttccaaggtgttgttctcgtaattcttgatacaacggctgtacaacgccagattacgttcgtccaacgggatggtagcccctttcttcgggatccaaagcggcccgaagttatcacgggtccagccagtattgtatccgaccggataggtagggccgcccaacgtctccggctcgatgataaccttcttcacggtaggtaacttctccgctatcgccaaggcctttttcgtgagtggcaggcgatataccgggttgtactgtcccttcgcgttaggcgtaaagcctaggtatgacaataggttttggtaataaccgccgctggaggccagcatacggtcatccttgcttacgtccatcaaacggaattgctcctctgtgatcggggaaccgtctgtttcgataaagtagttgaattgcatatctttcgggttctcggcgggtttaccgtctatgtacacttggttgtctatgagttggagcgtatcacccggcataccgatacaacgcttcacgtaattctcccgtttgtcgaccgggcggtacattacctcgccgaacgtggccttatccaataagatacgttcccgtccgtactcctcgaccaaggagtagtaatccgggttttgcactttcacggcgatcgtgtcgcctgcggggaagttgaacactacgatatcattacgtttcacgtggcccaaacctttcacccgtttgtagccccattccggccaatccagatacgatttacagtttaagataggcaacgtattttgtaccaacggaaaggagatcggcgtgttcggtacgcgagggccgtaacttaatttgctgacgaacaggtaatctcctaccagcaaggatttctctagggaagaactcggtatctgatagttctggaagacgaacaaattgatgaaataaacggctaccagcgcgaatacgatatcgtccacccattccaatacgttgcgtaccgtcgggttcttagaccgtttccaagctccccaagggatgtagtgcgtcaagaatatatcgactaggacgattaatcccagcagtaaccatacgttttgcatccagatagcgaacaacgtgtataatacggccgctatactaaacttgatccattgttttttcgtgaacttcttcatcttttagctaatacgtttagaatttgaataagtcattcatgcctaggaaacctttctttccggcggtaaactctgccgctattacggcgcctagcgcaaatccggcacggctcttggcatcatgcttgatactgatcgtatctacgtccgactcatacgtgatctcgtggatacccggaacctcaccctcacggatagcgtggatcggcaggtcggtcgcgctctcggcgttctctaaggtccagcggtctttacgatcgatattttccaagattccttcggccaacgtgatagccgttccactgggtgcgtccagcttgtggatatggtggacttctgtcattttaacgtcgtaggaggggaagttgttcatgattttcgccagatacttattcatggcgaagaagatatttacgccgatgctgaagttggaggcgtagaagaaggttttgccctctttctcgcatttctccttgatctcgccgatacggtccagccatccggtagtacccgatacgaccggcacgcctacctcgaaacatttcatatagttattgaaagcggtagccggggtagtaaactcaatcgccgcgtcggcgctcttgaacgcttctgaatatatatcctcagcgttattgatatctatgatggaaacaatttgatgtcctctttggatggcgatctgctcgatcgttttgcccattttcccgtaacctataagtgcaattttcatactttaattcaattaatgtcgcaaatatacagaaaatgaattacatttgaatccaaaatcttaactctgaaagaatatggaacgtttattacactatgtttggaaatacaaactctatgcgagtactccattgactaccaccgaggggcttcctatcgctgttatcgatcccggaatacaaaacaccgacgccggtcccgacttcttcaacgccaaggtaaaaatcgacggcacggtatgggcgggaagcgtggagatccacgaaaaagcttccgattggttgctgcatcatcatgattcagataaggcatatgactccgttatcttgcatgtaacgggtgtgaatgacgcatctatctgccggatgaacggtgagcctattcctcaattgatattatccgttccggaacctgtccggaaaaatatcgattggttattggtaagagaggtgcccgtcccctgcctcgagcggattcaagatgtggactccgtacatctggcctcatggatggatgccttgctcggtgagcggctggaacgaaagacagaggatatataccgtctgttggatcagtatcaagaggattggaacgaggtgttctatatcctattaacccgtagtttcggctttggcgtgaatagcgacgctttcgagtggttggcgaaaagcctccccctgcgatatatccaaaagcaaagggctagcgagtcgcaagtagaggcgatgcttttcggacaagcgggtatgctctcggaagagggctcctgccattactaccgtctgctgaggcgggaatatgagtttctccgccataagttcgggctcaagcctttggatgactccttgttcaaaagcctccgtatccgtccgaccaacttcccgcatgtgaagttggcgcaactggccgctatctggcatcggtacgatacgttattctcgatgatcctgtccgcttcttctcctaaagagatcaaggattatttccgtatccaaccctcggattattggaagaatcattatcatttccaatacgcctcggtggaaaaagataaaatgatcggggagaatgccttgaatatcctgttaataaatacggtagtccctctgctattcgcttacggcggtcgaaataaacttcctgagtattgcctgcgtgcgacccgcctcttggagagtatcccgccggaacgcaatcatatcgtaaccgctttcgctcgatccggtatcgaagtccataacgctggtgatacgcaatcactcatccagttaaaacgagaatattgcgagaagcgaaagtgtttgtattgccggattgggttcaggttgctaaaacgaagtgttaatcctcctcggtaaaaggagctcttatatacttgccgtctttatgattattggtgatataacgtaatatatcgatcacctttccggttgaaaaaacataccatgtggtatgcttgctgctttttcgtttgaaaaaagcgtattgcaaatctctcccgtatcggttgaacctcatttcagctgtatgggagagattataatgtggtgcatgaggtaaagtgtggatgaaatcgaggatatcatcgataagtatgtttgcgtactcaatgtatgaataataatctttctcaaataaggtgtcggctaaatccatcagataagtgattatttctttagggataataacttttgtgttattttctttgtgcgtttttttcatagaaatgttttcttagttcttgttttgcgtattgtctgaattcctcgatgctcaatcctttgttccaatctcgttcaaattcatcaaggttactatccgataggtttactcccaatcgtttcaatataggattgatcatatccccatatttctttaagtcgatgcgaacgtagctgttgttccctgccgcatctttctccaattcgatacctgatacttctgacatagttgctctatttatttggttatacttccatctattgcgaagatactgtttttaattaggtatctgccttatttcgggtgttttattttacaataagttcgatgtgaattactgttttgtaagagattgataaccggactcgaaaaaacacgtacatgttttttggaaaagtcgtacgtgttttccgaaaaacatgtacgtgttttcgggaaaacaagctgatgttttttcccggatgagccgcgatgatattctttaggagagaaaaatgacaataagggcttttctcttctgtgttacaaaaattagttggtgcggaatctgtgatgtgggaatatccggacaatgctttatttataacatgatatgattaagaaaatctctctttatctactcaaatatcttggaatagttaaatataagacctatatttgttgataggatttaacctattgttaataaagaaaggacggtggaagtaaacaaaaattttatcatgttattggcatatttatgccttagtcatatactgacgaatattcggggatacggagtactatatatgcttgatatctctgaggttggatcgggaagttatcagttaactggtaagggctttgggaggctatctttatggagttattgaaagatagtttttatatcgaatatttatgaacgtgcaatatgggatggagtatgagtaagaagtatatactgaggagtaaatggtttttgtctatggctgttcttttattatttgcgacatccaatgcgcaggagattacaaaggaaaaggaaccggctcggtttggtattggtatcgcctatggttttaaagatcgggtgaaggagctaatacatccgatagagcttacggtacggtataatctttcagaaaagcattcattttatgtgaatgtgccgttgggatggaaaagttggagagacgattatggttacgtagatcccgtcatacggggttactatactcataaaatgcgattgtatggcttgggcattggatatgattattccattgtgtcgtataagaacttagatctgtttgcgggtggaggattggaataccaaagattctattttcgatatcaggaggttcaagaaggaaagccttacccttttctgagagatagattcaatgattattctttatatcccaaagtgggattgagatatacgtggcgatttgtaggtgttgagtttgattatagatgctatttctccgtgagagggttggatcattattccgaacaattctcagatcttcctcgtgaagtggattatgatacacatatcgatcatgcttttcgatgtggagtgtattttttgttttaaacctttaaattgatttattatgaaacgaacaaagttgtttttatccattttggtatgttttcttttgctatttgcgacatccaatgcgcaggagattacaaaggaaaaggaaccggctcggtttggtattggtatcgcctatggttttaaagatcgggtgaaggagctaatacatccgatagagcttacggtacggtataatctttcagaaaagcattcattttatgtgaatgtgccgttgggatggaaaagttggagagacgattatgcttctgtagatcccgtcatacggggttactatactcataaaatgcgattgtatggtttgggcattggatatgattattccattgtgtcgtataagaacttagatctgtttgcgggtggagggttggaataccagagattttataatcgatatcaggaggttcaagaaggagagcctttcccttttcaacgtgatagattcaatgattattctttatatcccaaagtgggattgagatatacgtggaaatttgtaggtgttgagtttgattatagatgctatttctccgtgagagggttggataattattccgaacaattctcagaacttcctcgtgaagtggattatgatacacatatcgatcatgcttttcgatgtggagtgtattttttgttttaaacctttaaattgatttattatgaaacgaatgaaattgttgttatccgttttggtatgtttttttcagtatagttagtgcgatggcacagcatccagtgttaaaaccagacaaagacgtaccagagttcgttactccaaaaatgggatattattatgtattggatgcagggagtaatattgcccgagtaaattggactgtctcgggtgggtctttttcccttggttcatcccaaacctcaatccccggtgggaatttctatggtataaccgtatattgggataatgtgaagtctacaaatggtagtactcctcaagggaaattaacggctgaagtttattatagttcgggagttagcggagtgcagtcagcctcttacactcaaaaaataaaaagtttgaatggagtaactccgccttctcttacttcaaaaacttctactaatttagactatggagttcagaatataacagttttgcttggtcaaaaattttattacccgggacaaacaacaactggagataaaaatctggttactaaatatgagtagactttacctgaaggatggaaaagtggtactcaaacaggtgtatttactacttcttctgaatccatcaatattacgacaaataatgtcggtacaggaacagtcaaggtacgtggtgtaaatcaaggtgctgaatttgataaaagtgggtattcctctatatctttcactcgtaaatttggctttacggcttatccaacttctgttccttttggaaaaactcagactaatacatttaccactcaattagtgaaaggaatgacttatgaatggagtacgccctccggatggaaaatcaataatggaggaaatacgaaggaagggttggaatagaatagcgtaagtatcacctcaagtgtgtgccctacagatggaatagttaaggtccggttgaagaaaaatggtgaagtatctcaatggtataattgtccttataaaggaatttcagatccagcgataacttctacagctgcttaccaatttgaatatagtacgttagcgttggatgtcgcttcttcttcgttaagcaaggctacatggtccggaacgggtatatatgtggcatcagggcaaggaacagctgcccctaaagtgatatttacgaagtccggatctgttacggtgcaagctgttgttagcttgtcgggttgttccggtgtgcgaactatctctaagacatttaccgtatcacctttccgttatctgatttctggagaatccatgatttgctataatggtaattatacgattagtaatgtaactgttccttctgaggtacaattgacttggagctatactaatggcaagctagagatacagggaggacagagtacgaaaacagtatctgtagggatagctccgggtaagtttggagatgagtggatacgcttgaccgctagtttaggaggacaaagtgctgcggtatctaaagcgatttatgcaggatatccaacagtaactaaagttaccggaccttcgagtgtacgcctaaatcaaggggggagttttatagcgaatcctctttatgataatagtgtttgtgagtataaatggaccgtatcaccaagtcagggagcgagccaatctccttctcgtaatacaaattatataacattctcgattccgggcagttattatatagcgtgtcgtgcttatactactcagtgtggggcggcgggctctgcggcatcaacaactgtatccgtgcaaagctcttatatggtttattctgatggatccagtaaaattgtggatgtcatagaaaatcaattagagaatgacgagtcatctattttgtctgatgtggttgtttcaaatcaagtctcttatcagctatataatcaagcgacaggcctattagtcgctgaggggaaaatggaacgaagcgggggtacgcttgattttaatcaagtgaattccggcatatatattttaaggatacaagtaagcgatgcgatttttgaggttcatagagtagcgttcaaataattgagatacttgtagagcccctatctcttttatttaataggagataggggctttttcattttaagatagattaattagcgtatatatccttatcgttcacgggatttttccctatttttgtccctcaattgaaatgagagtattgaatggaagataaatatgtgagaaatagtttacggttctttataggggtacttctgctggtcgtgctgtattcgtgcgcgaatatagcctcgccgaacggagggccttatgatgaggctccgcctaagttcgtaagcagtacgccgttgcccggccagataaactataagggaaagaaggtggagattatttttgatgagttgatccagatcgataagcctaccgagaacgtgatcatcactccaccccaaatggagcaacccgttatccgggcgaacggccggaaggcggtcatcgagctgatggatacgttgaaggagaatacgacctatacgatagactttaccaattcgatctccgataataatgagaagaatgtattggagaattattccttcgcgttctctaccggcgaatccattgatagtatggaggtgtccggagtcttgctgaacgccgagaatctggagcctatgccgggtattacgatcggcgtgcatacgaatctggaggattccgcctttacgacgatcccatttgtccgtacttcccgtacgaacgacaagggagagtttacgattcgtaatatggcccccggaacctatcggatctatgccttggaggatgtgatgcgctcctacaagtacagccagcccgggcagcagatcgctttttacgattccttgatcgtccccgcgttcgagttgacgacccgtcaggatacgatttggaaagatagcttgacgatcgatacggtgatgacagtcggttatacccattttatgccggacaatatcgagttgcgcctgtttaaggaaaaagtagagcgtcaatatatgttgaagccggagcgtacggatgagaaaatactaaccttgcgtttcaatacctccttggatactattccggtaccggttcctttgaatttcaccccggcggatagcaattggtatttcttgcagacagcggaggaaggaaaagccgtgcattactggttgaccgattctttgatctggaagcaagatacgctgcaagtggaggtgaattacctgaaaagcgattccatgaatatacttcgtccgcagaccgatacggtacaatttaccatgcgtcgccgtcctgtggagaagaagaaaaagaaaaaagacgatgagccggaacccatcgagtttctgggaatgaacgtaaacgcttccggttcgatcaacctgtatgatacggtcgctgttacgtttagcgaaccggtagcggggttaacgaaagatcatttctatctggatcagaaagtggatacgctttgggaagccgtagacttcgatttctttccggatacgacgaactctttgaacttcttcatcaagcgcccgtggaagtatggagaggaataccgtttggaagtagactccgccacgatattcagtgcctatggtaaatggaacgatgtgtatagcggggaattcaagatcaagaaggaagatgagtacgggcatttatatatcaatattgagggagcggataccaccgctttcgtggaattattgaatagcagcgaccagccgatccgtaaggtgaaggtaaaagatggcggcgtgcttttcatggacttgaaaccggataaatattatgcccgtttagtattagacgtgaatgataacggtgtctgggataccggtaattacgccgataaacggcagccggaacttgtcttctattgcccgaagatattcaatatcatgcagaattggcaagtggaggagacttggaatatcaaggctacaccgatgaaacggcagaaaccgatcgatatcacgaagaataaaccgaaagagctaacgaaaaagaaaagagattacaaaaatgagggaacacagtcttcgtccaataggaacagcggtgtgggcggcttgcgcttctaaactgtatatatgcgttttctttttgtgtgtagcgagtcttacgtctttgcgggcacaaacgttgccgttatcccatggggaacgggtggattacgatctttattttaaatggggcctgatcatgtcgaaggccggattggctaccctttccgtgaaagaatcggaataccaaggagcgccgtcatggcattataacctgttgttccgctctgccggcgtgatcgagaaagtcttcaggatgcgtgatacgatggattgccattactcaaaggagcctcggctcttgttcagctcgaagcgcacgaacgagggagactactatctggtggataatctccagtttgagtatcaaggaagcggtaggatcgatatccactcgcatcgccatacattaaaggagacgaagatcgacacgatgctaatggcgaaagggcgtgtattcgatatgctgggagctacgatgtatctccgttcgctggattggcggacgatgagttatggtgcggagttccctttcatgatcgctatcggccgggagctcgtgaacgctcgtttccgctatacgggacaacagatcgtcgagcataaggaggcgaaattccgtacccgtcatttctatatcgatatctacgatgaggcattttcccaagccaaggaagcggcggaggtttggatcggtgatgacgagaaccatatcccggtaaagatccgggcgaaactgaagatcggggcggccgaggtctattataaagactcctataacctgcgtgccccgcttacttgccgtatcgtggtgcagaagaaatgaaagctttttagataggcttgtgtttctcgcacccagctcatcacggagctggggcgagagctttttatagaatttcttttttaaaccaacggagtgaagggtaattccgtgtctttgcggtaacctgtaccattaaaagtcgcgattaattcttcggcttcattggtgatacggacttcgcaattcgccagtctcttatggctgaacgcttctttcgcttccgcatataagtatcccttactctccgccttaaagaaattgatgtttgaggtaatggataatgtcaggcgtgcgtggctattagtcgccgcggcgaaagccagatccgccaacgtgaagatcgccccaccttgacatacgcctccaccatttaaatgttcgggcttgatgagcatacgcgccttggcgtaaccgttgcccgtttctaataattcaacgcccgcaagcaaggcgaatttatcgccttgaagaaattcatggattgtcataacctcttactattcgcttggtggattatttgcttagtttccattccgctccatccttggtatccttgatctcgaatcccatagcggttaattcgttacggattttatcggaagttgcccagtctttgtttgccttggcttgctggcggatggacagcaataaatccacggctttgccaaacgcctcgtaatggttgccgctggcggaagcctcgtctttcatgccaaggatatcgaacaagaataaatggaatacctcttgtaactctttcaagtcttcctcggacagagtagccttaccgtcttttacggaattgatcgcacgggtagcgtcgaatagatgagaaatcacgattggtgagttcaaatcgtcattcatggcctcgaaacatttctcacgaagacctttcgtgtctacggtagaggtagcggacggctgcaacttcatcaaatgtccgtatgcctccatcaagcgtgacaagcccttctcggcagcttgcaaagcctcattgctgaaatcaaccgtgctgcggtaatgcgcttgcaggatgaagaaacggatggtcatggcggaatacgcttgttgcaaggagggatgatcacccgtgaagaattgctccagtgtgatgaaattacctaatgatttacccatcttctgcccgttgatggtgatcatattgttgtgcatccaataatgaaccatatcatctccttgggaagccacggcttgtgcgatctcgcattcatggtgcgggaagatcaagtccatgccacccccgtggatgtcgaaatgctccccgaggtatttcttgcccatagcggtacattcgcagtgccaaccggggaagccgtcgctccacggagacggccaacgcatgatatgctccggctgggcgcatttccaaagggcgaagtcgatggcgttatgcttctcgtcctgcccgtccaacgcacgggtcgtattcaacatatcctcgatattgcgacccgagaggatgccgtatctatgatctttattatatttctctacgtcgaaatagacggagccttggctttcgtaagcgtagccgttatccagaatcttcttgactaactcgatttgttcgataatatgtccggaagcgtgcggctcgatgctgggaggaagtacgttcagcgcatccatcgcttgatgataacgattgaggtaatattgaaccacttccatcggctccaactgttctagccgtgccttcttggcgatcttatcctccccatcatcggcgtcgtgctccagatgccctacatccgttatattacgtacataacgcactttatatcctaggtgggtaaggtaacggaatagcaagtcgaacgtgatcgccggacgtgcgtgtcccaagtgggcgtcaccataaaccgtggggccacatacgtacatacctacatgcggctcgtgcaggggtatgaattgctccttctttctcgtaagcgtgttgtaaatattcaatggatgttccatattctattatatatttaggaatcgcgaacttacataaaatccttggtattatcaagctgatcgtgaatagtctgtagttttcataggcattcattgactcttgatgacttccgacggattctcgttggctgccttacatacctgttcacgtatcgtacctagaaccatgctggtaatggtgatgaatattcccaccaaccaccagatctggatttggatgcgataggcgtagccttgcaaccagtagttcatgacgagatagctgatcgggaaagcgatgattccggcgatgacaattaatcgcatgtattccttgaagaacaagaaaatgatctcggaggctttcgagcctaccactttccggatagcgatctctttacgcctccgtttcgtggaggctgtagcgacggcgtagatgccgaacaaggagattagcaaacaagcgaaagcgaggaatgaaaagatcttcaacccgactatctcggattggttcagttgatcgtaaagcgttccgatcggggtgatccgggtatccgctaatgtcgggtctatcttgggcagtagctccgtgatatggtgggcgatgtttccttcctcacccgctacgacccggatatacaaattattcaccagtccgcccgaaggaatgaatagcatcggatgaatgctctcccggaaggatagcgcatggaaatcgttgacgacaccgacgatttcgtattctttgatcacactgaaatcagaccaccacggcatacggatgatactgccgaccgggtcttgtaagcccatggctcgaaccgccgactcattgagcacgacactaagttcgttgccttctgtccaccaccggcccattaacatctttaggtcgaaggtctcaccgaaccggtgatcggttccatagaggtggaagtccacctttgtgtccagcggttttccctcccattccacattcgtgaagatcgccatgggatcgacatgatgttgaggcttaaagttcgtgtcggtgaaacttttgacctgcggcagggcacttaactcttgcatcaacgtggattctattttcccggatacgtctacgaagccggatagttggataaggccttttggatcgaaacctaaatctttttgatttacgaatcgcatttgctccatgacaaccagcgatgctacgatgaacaggatactgatcatcaattgtaaggttacggccatgcggcgtaacaaaaggggtttgactgtctctttgggaacgagcgaggtggttgccgtatggctgaactgcccgaagaatactaatcctgcacattggaggatgagaaatgtacctatacctacccctgcgaaaagaaacaggaaccggcccatctccaaatcaatctccagccatcgggcgaaaagcggcttgacttggactatgaagatcaaggctaccaacaaggatgcaagtacggaacagcctagctcgacagacatttgttcgatcaattgctttctcgttgcgccgttgaccgtccgtaaacgccattcccgcacacgttgccgaaagagatccatgtaggaattcaagaaattgaagagggcggcaaacaataatagggcaccagatacgacaaacaagccgatgaaatttaaggtgaagggtgtatcttcattcagatgatgccggatctcacggatggggagtgttcgcaactcgatctccttgttcaccccgatacgttcaggtagctcttttagttgattggcgaaggcttttgggtctgagcttggatggagtttcacgtataagtccatcacgaagaagctccattgtgcctccggaggtaactgggagaaatgctgtatcatgttatggttgatgatcgcgtcgaacggtagattggtatggggtgatgggtctttcaccacagccgtgacgatgtagggaggtaaggaggctctcatcaaggtgtgtatcggttgcccgatcgccttttccgcgtcgccaaatagacggaccgccgtacgttcgctcaagatcatgttgtttacgatttgtagcggatgattcatttctccacaaacgaaagattgcgggaatacctctaggaacgtactgtctgtataaagcatattcatttggatataaggagtcgcttgggtacggcagttttcggttgaaagcataagcgtggtggaggcttcgatagctgggacttgctctcgtaagctattctcgatacctttcgaggctcctttgttcactttcccggattgtttctctacgctatagacacggtagatggattcggaatccttgtagaaagaatcgtaagtggtctcatgatccatccaatagagtatgggcacgaaacagacgagggcgaaagccagccctaggatactgatggaggcgctgactttatacttccagatgtttttgaaggcaatgacacagtaatgtattaacatggcaattccgtttttttgatgatatcgctgatgactcaatttcgctgaatccgattcaaatatcatgccataaatgtaacgtattagaaaatagaatcatagaaaaatctgtatttcttcatgtagtgcgatagcgtacattttttgtgcgataatgcacatacaagctgtctttattccctttatctttgtccgtatggaagaaaaggggaaaatattgatcatcgacgataataaggatgtgttgttcgcattgaacttactgttggagccgtacatgcaaaaggtgaaggtaacgacacaaccggcacgcatcgagtatttcatgcggacgttccaaccggacgtggtcttgctggatatgaatttccatcgggatgccgtgagcgggcaggagggttttgagtatttgggacaaatcttggagatcgatccgcaagcggtcgtgatcttcatgacagcctattcggatatagagaaagcggtcaaggccattaaggttggcgctaccgatttcatctccaagccgtgggaaacggagaagttgctggctaccctctcgtcgggcattcgattgagccattcccgtaaggaggtcggacgtttgcgggagcagatgaaagccatgaaggaggacgacacattgccggaattgatcggtgagtcgccggctatgctgaaggtaaaagacacgatctacaaacttgtggagaccgacgcgaatatattgattaccggtgagagcggtaccggaaaagatctggttgcccgtttgttgaggcattactcgccccggcgtgacgatgctttcgtgacgatcgacttgggaagtatcccggaacaattatttgagagtgagttgttcggctatgagaaaggtgccttcacggatgcccgaagatccaagccgggacgtatggagatggcttccggcggtacgctctttctggacgagatcggtaacctgtccttgccgatgcagtctaaattgttgacggctatagagaaacgtcatatcacccgtttgggagcggtggaaccgatctcgatcgatgtccgtttgatctgcgccaccaacgccaatctgcgtcagctggtgggcgaggggagtttccggcaagacttgctctatcggatcaataccatagagatagccataccaccgctgcgtgagcggggagaggatatcttgatgctggccgatcatttccagaggctgtatagccggaaatacaagaaaacgatcaaagggttgagccgggaggcggggagtaagttgatgaaatacccttggcccggtaatgtccgggagttgcagcatgttttggagcgagccgtgatcttgaacgagggcacggtgctgagaccggatgatttccctctctatacagcctcttacgagcggaagaaggagctggaccctgatttgaatctagagcaagccgagcggaaaatcatcgggcgagccttgcggcaaagcaatggtaatatgagctatgccgccgagctattgggtatcacccgtttttccttgtatcgtaaaatagagaagttcggcttatgagatcgtatgcgttcacggtcatctcgcacatcgtaggcatcgtcttgtctacgggactcctgttctattgcgtgcatgaggagattatcttttgtcctactttttgcgggatcgcgatcttgtatttctcgattcatctttatttcatacagatgcggcaggtgaagtattggcgttatgtggtggattgcttgcggcagcaagacttgatccagatcgttcgttcaccttacgaggataaggtgatgcgggagttggcggacgatttgtccgcagccctgcgatccttgcgtggccgattgatggacgaggaggtgaggcggcagtattttgagagtctgttgaataaggtggacactgccgtactcgttactgacagggaaggggctattgaatggaagaactgggccgccgacgcgttgctggatacgaggtgtcggttacccaatgagttcttggaggctatcaaggcggggaagacggtggtgcgttacggaaaaccatccgttccgcaagattgggcgatcgatgccactcgtatcgacttgcgaggttgcgagcgttggatcgtcagcttgaagaacatccattctaccttggagcggaatgagatggaggcttggcagaaattgatccgtgtcttgacgcacgagatcatgaactccatcacacccgttatctcgttgtccgagaccttgagcaaacgttgcaaagcagatccggatgatgtccggaatcgttcgtatatccagcatggggtaaatgtcatccatcgccggagtaaagggttgctggatttcgttgagaattaccggagattgacccggatcgcctctccggtaaagacccgtatcttagtgaaagatttcttttcggatttaaggcgtttgtgccctgagccttctatccgtttccgcttgccggacgagcctctggaatggttcgcggatcgggcgcagatggagcaggtcttcttgaacttactgaagaatgcttgtgaggcttgtgcggaaaagccaaaccccgagattatcgtggcggctcagcgggagggaaacgaactcgtctttaccgtgcgagacaacggtatcggtgtcttacccgaggttatcgaccgggtttttgtacctttcttcaccaccaagccctccggctcgggtatcggtttaagcatctgtaagcaaataatcaccttgcatggcggccatatctcggtagaatccgagaatggaaagggtagctgtttctttttgtactttaattgattatcagcctattgcagtttttctaaatttcttatacggaaaactttagtttcttcaaggaaaaactttcgtttctatatagggaaacaaaagtttcttactgaggaaacttttgttttattaggagaaaactcaggctgctattataggagattcgtgataggattcatgagacggaaagttattgtctgtttttagtgcgcttaccctgtaaaatacataccttcgcggatatatttaattgattttctatgaaatggtatctatggggggcagttgtcctgctttattccctgtttggaagcgcttgttctacggaacggaggtatgatttgtcggcttatggtttatccccggtcgagaatgtggataatgcgcccgctatggcgagggcattggagcagatacgggagaaatgcgaggaaaaccagaccattgtggtgaccttgcctaagggccgctatgagttttatcccgatagcgcggcggagcgtgtctatttcatctcgaatcatgatcaaatgaatccgaagaaagtaggtttgcctttcgaggggatgaagaatatggtgttcgacgggcaaggctcggagttaatcttccacggcaggatgttgccggtctctttgctggattcgaggaattgtgtcttgaagaatttcagtatagacttcaagcatcctcagatttcacaggtaaaagtggtggagaacgatacgctgaaaggcgggatcaccttcgaggtggctccatgggtacgctatgagatacgggatagcgtgtttgtagcgaagggagaaggctgggagttgactcccggttccggtatcgccttcgagggagatacacgtcatttggtgtataatacaagcgatatcccggtaggcgtgcggggcttgatcgaggtttctccaaggctgataaagtctccccgttggaaagacagccgtttggtgcccggtacggtgatcgccatgcgttcttgggaacgtccggctcccggtgtcttcctgtatcatgacgtgaatacgactctggagaatatcaaggttcattatgccgagggaatgggcctcttggcgcaagtgagcgagaatatcacgctggatggtttctccgtttgcttgaaaggggcggacgatccgcggtatttcacgacacaggcggacgctacccatttctcggcctgtaagggagcgatcatctccaagaatggcttgtacgaagggatgatggacgatgctatcaatgtgcatggaacttacctgaaagtggtgagacgagtgaatgactcgaccttggtaggccggtatatgcacccgcaatcgtatggtttcgaatggggaagggtaggggattccgtgcagttcatccattcgagcaccatggaattgataggggcgagaaaccggattaccgctatcaaggcggtagatcaaccggattaccgaggggcgaaggagttcgagatccggtttgagaatacggtgaatccttcgatccatgagggaagcggtttcggcatagagaatctggagtggacgccgacggtcctattctcggataacttaatccgtaataaccgtgcccgcggttccttgttcagcacgcctcggcaaacggtcgtagagaataatgttttcgatcatacctcggggacggcgatcctgctgtgcggtgattgcaacggctggttcgagaccggcgcttgccggaacgtgttgatccgtaagaataagttcatcaactccttgacgaatatgttccaatttacgaacgctattatctctatttatcccgaaatcccggatttagcgtcgcaaaggaaatatttccatagtgatatcgtgatcgacgcgaacgagtttattacgttcgataggccattggtatacgccaagtccgtggacgggttggtcttcacgaataatattgtcaaacaaaataaggaatacccagccttccattggaataaccatcgtttctatttccagcgggtgatccattcgaaaatagagaacaactattttgatgaagggtttatccgggagagggatgtcttagaggaaaataacggatatgatatataggaaattaatcgtcttggtaagccttttgataggcttcgtaaacattgcgttcgccggcgttggtgatctcgatacgttaaacgtacgttctcaagcccctgtcaaggagagaatgcctgtcgtcgcctataagtttaacccgaaaagcttgattcttccggcctcattgataacggtgggagccgtaggcacggcgattgacgggatgaatgactttcacctgttttcccggaaagattccgtgaagcaaatccatatcgacaattacttggagtggggaatgctcggttgggtatttgtctgcgaccttatgggaaaagagaagcataactgggtggaccaactttgcttggtcgctttagcggaggggatgaacggattgatggtgcatggactgaagaactgggtaaatgagcctcgcccggatggggcgccttattcgtttccttccggacatacctcgaatgctttcttaggggcgcatatggcttataaggaatttaaggatagctcacctatactcgcttactcgggttatgcgatagcggcgttcgtggcgggttcccgcttatacaataacaggcattgggtggcggatgtagtggctggtgccggcttcggtatcttgtcggttgagttatcgtatctgatctatttcccgattcgtaacgctatcgcccggcggatcaatcgaaatgtgaagaactgcccgatcgtggccgctccggtattcagttcgaatatggcgggattctatctgacttatcaattttaatgcgtcttatggatcaagcgcatgtcggcttatagagactggttgatgcgcaaaagctcctctatatgcgtgcggtcgttgctgaggcgtgggatcttgtgttggccgcctaatttgcctttctgcttgagccattcatagaaagcgccgtcgtgggcgataacgatttccagcggttggagggagatctctttataccgcttcgcctcatagtccgagttcagcttttgtaagttctgatctaataaagtggcgaattcatcgagagattccggtttcttgtcaaactcgataaaccattggtgccgtcctttcgccttatccagcataaagagtggggcggcggtatattcttttactttcgccccggttcgtaggcaagtcatggcgatcgctttatcggcgttatccaccattagctcctcgccaaaggcgttgataaagtgcttggtgcgtccggagatgacaaatttatgagggaataacgaggtgaaacgtaccgtatccccgatctgataacgccataatcctcccgaggtcgtgattaccatcgcatagtttttcccggtctctaccgattccagcggcaacacggtcggatgggcgttacccacctcgttcatcgggatgaactcatagaaaataccgtaatccggcatcataagcaaactggagtccgtaggatcgtcttgcagcccgaagaagccctcggatgcgttataggtctccatataatgcatcttattcgatggaatcaaggttttatattgctcccggtaaggctcgaaactgattcccccatggaagaagacctccagattaggccatacgtccgtaagatattccctacccgtttttttcaatacggccttgatcaataccaacatccaagaaggaacaccggataggctgtttacatccttattccaagtgttctccacgatcgccttgatcttgctttcccattcatccattaggataatgggtttcttggggacgcgtattaaattgacgagcggattgagattttgaagtaatacggcggataagtcgccttgatgagcctcggagtttagcggggaagggctatggctaccgcccaatatcaagcctttcttggagaagaaacggctttccgggttgttccgcagatagatggctacgcaatcaaagccgcctttatagtggcaaccctttaatatctcgggggtgacgggcaggaatttacttttgtcgttcgtggtcccgctactcttagcgtaccaccgcaccaccgaaggccagagaatattcctttctccgtttatcattcgggtgacatacggctttatctcgtcataagtctgtaagggaagacgttggcagaagtcagaataagagcgaatgcttttataatcatatttgagtccccattccgtcttgcgtgccgtcgaaagcagagcatgcagctgtttgcgctggatatggtctatatcctgcccaaatcgtccgatctccgtttgtcgatggcggaaaaggagcgaaatcgtctgtgttaaaatatccatgccctttttatttgttcgagtgcaaatgtaggcattctctttttatttatatctttgctaagtactaaattaacgttacgatgaaaatagggattctctcatcgggtggcgattgccccggtatcaacgctacgatccgtggtgttggcaagaccgctatcatgcattacggcatggaagtgataggtattcatagcggttttataggtcttttgaataaagacgtccaagttttcgatgaacggagcttatccggcatattaaatttagggggaaccattttaggaacgtccagagagaagcctttccgtaagcttttggcctcgggagattcggaaaagccggagatcattaagaaaaattatgaggagctggggctggactgcttggtttgtatcggaggtaacggtacgcagaagacggccaatctgttatctcagatcggattgaacgtgataggcgttcccaagacaatcgataatgacatatggggtacggatattacgttcggttttaataccgccgtgaatatcgccacggaatctatagaccgtcttcattctacggctagttcacataagcgggtgatggtcgtggaggtgatgggccatcatgccggatggatcgccttgtatgccgggatggctggaggtgccgacgtgatcttacttccggaattgggatacgatatcgataaggtgaacgaggcgatcttggatcgggctcgcaggggcaaaccttattccatcgttgtagtagccgagggtatcgagactccggataaaaagcgtccttctgattatattacccgggctatcgaggcgggaacgggtatcgagacccgggataccgtattgggatacacccaacggggtggaaacccctctccgttcgaccgtaaccttgcgactcgcttgggaggccatgccacggaactgatcgctaatggtgaattcggacgtatggtttgtatgaaaggagatagggtagaatccattcccttgttagaagtagcgggaaaactaaaattagtgacaccggatcatgatttgatcgtacaaggaaagcggatgggggtaacattcgggaaataaaataaaaaaggttgtgcgttctctgacacacaaccttttttactttatactagtaggcggccgtttatttcttaataccttgaacggtttggcttcccttttcagtagtcaagcgaaagatatacattccagtggcaaaatcacccgtgctgagactgcttcccggttgcgggatgctacgtatcaactttccatcggccctgtagatctcaagcgatttcagttgttgataattctggatctgtacttcattcgagaagatacgtggttgaatgtctacttcttcgcctgttggcttcagttcgttacctacgctcgtttccggaattaccgtagccggagcgctctcgtcggtaccataaagtgccgttacttggagcagaggggtacttgttgccagatttttcaccgtataattccgttgagaaacaggtaatgtcgtcagttcccgagtatcttgatataccttataaccggtcagctccggaaaagccgtaatcaactctgcttcttgcgcatcggaggcgatagccagtttccggaatgataatcggcccgttctcatgggttgcggtttctccgagaaagtgctcgtggagaatacggaacttgaggggaactcaccttcttccgcgcttattacgatcgataacacaacattggcatctagctcatcatctgagaatgtttcccatttttttccgtccaaagaatataaattcccttttccatcgactgcggggccttcatcggaacatgccgggtatgtgttattggcatagcttatcacatgaatggctaccagtaaatcctgcttcgcgtcgattacgaatggtgttttaagtgtgaccgaatttattttacctgatttcagttgagtgaaactctcttcatactcccggtttccctgtttgatatagactccataggtgactccttcctgcggatagaaattaaccttccggatcgtttttttatgcaccggttgtagatctttcgtatcccatttctgagcgaaatagaatggatctcctccgagaccgaactgttgataacgatcttgtgatccccaaccagctattttttcgaggactggggcattccatgtcagttgaatctcacccgtggagatctgtttgtatttcaaatcagtcggactttcatactcgtttccgatcgttttcccatcctgcgtcattccctgcaacgaggtgacgcccgttccgagtggatctagccagacatccatccgggctgtatcattatcactgtatttattccagtgataatacaatttaccgtataaattcaatccttcgggcagttcgcaactggagcttccaccgctcagcgtacctataatcaaacctttgctattaaataaaggcgagccggaagaacctccctcggtcaccccgtgtccgtttagcgtggcatcgaaagtcgcgttccaatgagcgttcgtggccccggttttcccaacatcactattacgccatgtaatcgattctgtcggataatttccataggtggagattttcatataatcgccggaaggatgatggatgcctacgcccgagagtgaaagcatatttgaacgatcccatccgttaaagaatacattataatcgtcggggatctcgtcgttaagcaacagcaacagtccgtcggaaccgttttcgacaggggtagaggctttccgtgtacatcctaccatggtttttatcggataaatgggtgactcattatcgcagcccacatgttcttggtggaaataaaacaaccagactgctaattcctcgggagtaaccgtctgttcgcccagcatatcttgcgaacaatggaaggcggataatacataaggctttttgtcacgggccgtattatttaccagagaagccgtacaaatatagcttcctccttctccctctttattacggatgtattgaatcatttgtatcacccccttcttttgctcctgccaatcggctccctcctcgcaattgatattcacttcgcaagcttctgaaaagccggctcccggcgcttcctgtacttctggcatgatcgcttcaagatgattatacccgtaaccgacctcccggatgcgtagtcgaggtgtctcgccggatggtgccggtacatattcgaggatcacctcatcgcctgctacggcttgggttgcgaacggtccgttttcaggatgcgtacgatgcgtataggcacccaatacttgggttttcgctgcgttatacaggtataaccgggcacctttggggatataaaaatcggagtaatacaggatcaaggcgatcgctcctttcgcttgaaggtgaagttgccatacttggctgccgtcgggcagtgaaatccaatcgccactatcggcgatgtcgaagctggttgggatcgacttggctacacgcaacggagcgccttggctgaccctccacgcatcgaccgtcttgaggtcttccacactgaaattcactggaacttgttctgctagcttttcacttcgaagtgaacctgcgaattgaaagctgggggggagtcctccttcgctgatctgcgccaacgaacttgaaatcgagaaataaccgatacataacatgccggttattaatattcggagaaatttactgtactgttttttcatacatacaactttatatgagcttattcttatatagctaagaacttgggtatatcaaacgatgtacccaagttctgctgtttatcatacagtttcttcctctgggaggtcagaaaactctttttcatcggttagttcaccagtcttctttttctttgtggcagagatacgttgctggagttctttgtctgtccgcaatcttttgaccgccattttagaagccgcttgctgggattcttttttggagtaaccgatacctatgccaatttgctcgcccagcaatttaatcgcactttggaatacaggattcccatcatgatccgtaaaagactctattagatcgaacgagatcgatattttgttcttttggctccattcaatcaagtttgacttgaaatttatctctttccggacgagcatatctacatcgatatacttttctatcatcacgtcacggataaacttataacaaacgtcataaccttgatccagataaatagcgccgatcaaagcctcgagcgcattaccatacatatgattgttatgagagtttatcttggttgaatagactaccatttgatcgaggccgagttgtacggcgaccttattcatcgtttcccgttgtacgatcttggagcgtgtgtttgtcaaaaagccttcccgcttatttgggtagcgcttatagacaatatcggcgaccgccgcatccaaaattccatctcctaaaaattcaagacgctcattgttaagccatttaccatcacccgtctctaccgatgatgatttatgcaacaaggcctgctcgtaaatctggagattatccggataaaaacctagaatctttgataaagacaaataaggctccctacctttattatgcaggagccttattcttttatgtagctgtttgtatagctttctaaacacgttatttcacgaattttttaacaatggcgcaagcgttgtgtccaccgaaaccaaacgtattcgataaagcggctttcacttctctcttttgagccttattgaatgtgaaattcagtttataatctatttcaggatcatcgtcgccttccgcatggttaatggtcggcgggataataccatcgtttatagccataatacacaggatcgcctctaccgctccggcagcaccaagcaagtgaccggtcattgactttgtggaactgatattcagttgataagcatgttctccgaacacatctttgatcgccttaacctctgagatatcgcctacgggagtcgatgttccatgaacattgatgtaatcaatatcttccggagccattccagcgtcttccaatgcgttgcgcataaccagcttcgctcctaaaccatccggatgagaagcggtcaagtgataggcatcggcagacattccggttcctgcgatctcgcaatatattttagcgccacgagccaatgcgtgctccatttcttccaataccaagcaagctccaccttcacccatcacgaatccgtcacggctagcgctgaacgggcgagatgcggtctcgggagaatcattacgtgtcgataacgcgttcatggagttgaatccacctacacccgattcagaaacagcagcttccgctccaccggtgatgatgacgttagccttgcctaaacggatataattgaatgcgtcgctgatagcgtttgtagaagatgcacaagctgagacggtcgcaaagttcgggccgtggaatccataaagcatggaaatatgtccagccgcgatatccgagatcattttcgggatgaagaacgggttaaacttcggaccgatcgtatccttgatcttcgcataactcaatacttcctcgtcaaatgtcttgataccaccgatacctgaagcgaaaataacgccgatacggttcttatcttctttatccaagtccattgccgcgtcctcgatcgcttgtttcgccgcatcgatcgcgaataagctataacgatcacacttgcgggcttccttacgatccataactttcaacggatcgaagcctttaacttcgcatgcaaattgtgtcttgaatttggatgcatcaaactgagtaataggtccagcgccactttttccgttgataataccttcccatgtttcggggagggtattaccaagaggagtaatagctccaagacctgttactacaactctttttaattccatacctttagttaaaaggattgattacttcgcgttagcctcgatgtaagcgatagcgtcacctacagttgtaatcttttctgcttgatcgtcaggaattgagataccgaattctttttcgaattccataatcaattctacagtgtcaagagagtctgctcctaaatcgttagtaaagcttgcttcgtttgtaacttctgtttcttcaacacttaacttgtcaacgatgatagcttttactctttcagcaacttcagacataactttttcaatttagattaataaatacgaatatactttttaaatttgcagtgcaaagaaaagaattttttatgttacaaagcaaatttaataagctaaaaatgcggaaaactgcacattttttcttttcttgtgcatttaaacatctgaaaatatgaaaaacatagcgatttttgcttccggatctggtacgaatgccgagaacatcgcccgatattttgctaacagtgaaaacgttaatgttgcggttgttttatcaaataatcgtaatgttggcgtgcatgggcgggtaaataagttgggcgtaccttctttcgtgttttcacgggaggaatttattgccggtgtgccgatcttggaaaagttggcggaatatgatgtctgccttatcgtgttggccggttttatgaataagatctcagacgtgattcttcaggcttttcccggtaagatcgtgaacatccatcccgcgttactccctaaatatggcggcaaggggatgtatggcatgcatgtgcatgaggcggtcgtgaaggctggtgagcgggagtcgggtattactatacattatattaatgagcattatgatgagggcgctatcatcttccaggcttcttgtccggtattaccttcggatacgccggaggaggtagcctcgaaagtgcatgccctggagtatgcgcattatcctcatgtgatcgaaagtttactgtaaggcttttttgtcattagcctacttgaaaacctagtttctggagtacggcgaattcttccgggtcagctttgatcgcttggtaagcatggaactcacggggatggtcatacgctgccctaaatcgctcgaaatgatgaggattcgctcttagtgcttggtcgattacttctgggttgaaacttctcaagatggcttcttccacccggtgctccttgaattgtcccaagtcgatgaatgggttggttggggtaggcggaatgacttccttgatcttttcgatacggataccgaaaaagcatcctatattctctaggcacattcgtgtcccgttcgccttcccgtcggcggagaaaccggctatatgaggagtagcgatcgtggcttccgacagtaatttccggtcgatatccggctcgttctcccagcaatcgatgatcagttcgctgaccttgccggttcgtttggcctgcaataaggcctgcgtatcatgtacggcgccccggcaactgttgataaaccatggttttcgttccaatttgtcgaaaaaagcaggatcggcgagatggcgggtggcgaaacgtccctctttggtcaacggcacatgcaaggttatgatatccgcctctctcgcgatcgtgtccaaggatacgaatccaccgtcgccttcctgctcggcacggggcgggtcattgcgaagcacacgcatccccatggcctcgcatagcctctctacgatactccctacatggcctacgccaacgataccgatagtcttccctgctagtctctctcctttgcggagggcgacggctaccaaagaggataatacatattgccccacggaagcggcgttgcaacccggggcgttcttccacgtgatccctgccttctcgcaataatggatatcgatatggtcgtacccgatcgtggctgtcgtgatgaggcgaacccggctaccttccaatagctcgcatgtacatttatctatgctacgtacgatcaaggcatccgcgtcttttatgttcgtgggcgtaaactctttggagtcaaggtaggatacgtccgctatcggctccaagatcccttttaggtaaggaaccgtgttatctgctattattttcatcttatcagcttgattatcgttacgcgatattaagtaaaaaacaggggatatacaagtgatgggagtttcgcttcttgtgaattttatcatgcgcttttgttttcggaggaaggatcccgggaaaacacgtacgacttttccggaaaacatgtacgacttttcgcgaaaacatgtacgtgttttccggaaaagatcattctgtttttggggtattgattatcaatgtgttatatacggtctcctttttacgagcttattgtacggaattttattggggatccctgtattccagcttggcaaagacggatggttaaatgaaagagccgtatggaaacggtcataccccgttggttattttgtatcaaatgacataaactaaggactgaatgtcacaactcaaggttgtgaggaaggattcgtcattaaataaaggcgtacattgcgagtgtcaaaaacaaataatagatggaaaaaagattactgttatgtttattgtgtgtcgtgagcgtggccttctcgttggaggcccgtcagcgtactgaggcggaggcgttgaggatagcccgctctttttatgagggacagggtatgttacgctcggccccgggatccgattttcggttggtgtatacgggagaggggagcggcctgcgttccgtgtcgtccgatccgtattactatatctataatgtaggggaaggggatggtttcgtgatggtgtcgggcgacgaccgtgtcgccccggtgctgggttactccctgtcgggctctttcgatccgggagatatgccgtcgaacatgaggggttggtttgaggaatacgagcgccagattgatcatgcccatacgcagcttgaacaggtgtttccggagaatgtttcgtctccgcgttcagacgatgggtttccggagcgagtggagccgttgatacagacgaaatgggatcaaggcgctccttacaatagtctttgcccgttggatggggataagcgttcagcgacgggttgtgtggctacggctgccgtccagatcatgaattaccaccaatggccggagaaagcggtaggtaaagggcaatatcgaatgggagaggaaaatgtgaacgagactgttttctccgtggatttaagtggctatacgtttgactggaagaatatgctggatgtgtacgactctacttccaccgccgttcaagataaggctgtcgccgagttgatgtatgctgtgggcgtggctggtaatatgctctattctgctgctggcagcggaactatggacgaatatatggccaagggattgatcgagaatcttaattatgataaaaatctgctatgtctgcatcgtgactattatatgaccgcaggctggaaaaggttgttgaaagtcgagctcgcggccaaacgtccggtcttgtacggggggacgtctacgagtggtgggcatgcctttgtttgcgatggctatgataaggacggcctgttccatatcaattggggttggggaggagccgctaacggtttcttcgagctggatgtgctgaatccatatattaaaacgtatagcggattctcttatggtcaagatatgattatcggtttccagaaacccacggaggcgagcgagccttatctgtcgttgaatgttaattcggtgaatgtagatcgtccgtcgatctcgcaaggtgattctttgggcattgaatatgccctacagctagatgcctcctccgagaaggagctagaacttgctctaggagtctttaccggagatagtctatccaagatcgtttatgaggaaaagggcgttataagtccagttgtggtttcaccttcttttttgtggaagactgatccactatgcttggatccgggtctatacgggttgagggcgttgtatcgtgtatctggcgaaaaggagtggcgggagctaaccccttcaagggtgaggaataacgaaatccatttgttggcgacggattccttgatagaggtgatatcctacgctgatgaatatacagggacacattctgtctattcggaagagagcttggtagtggatggctcgaacgtgttgtgcacggtgattcgcaacgagagcgcctatgagcgtaatccgatgatagtcttcatggcgcattcgttgtctacgggggaatatacggacttgtctattgaaggcgcttactttcagtcaggggaagagaaagaggtacgtactcaaataaaagtaaacctatccccgggtcgctacgtgctggctgcgtatagtgtggtatctgatggtctctattttataaaaggaacagaggtatttgtaaccgtggaaggcgttcccacaggcatccatccattggcggttgatgataagcttcgggtcctggcgggagaaggccgtctgtccgtatccttcacgtctccgctccatgaggcttacttatacgatgtatcgggcaggctttgctctacgggcgtgatgaacgggacggcggggtccgtcctttctaccgctggtttatccggggggatctatgtgttgaaagtccgtatcgaacagggttgggcggagaagaaaatagtattgtgacaggtaccggaaagttttaacttcacgggagatctttatgcgataacagagaaaatgcaaaaatgaaaaaagggattatggctttatgcttcatcgcttcctgctgggggatcagttgttcctccagtcggaagcaggctgccgggttagaaacgaccgacagccggttttccggaatggtgccgacaccagcttcttccggacggatttcttcctccgtgcaagcggctcctcctgtggtgatctataagacggcgaaagattatagccgtcatgtcccggttggattgagtgaggatggccagacgattgtctcgtatccggcggtaagcgatgtgaaagtgggggataagtatccctacccgactcctttggccgatggctatctgttggataaccggggtatcgggcgcaacgtggctttcttgtcttacacgtacgaggaatacgcggccttgccatctacgccgtctcgctccgaattactggagaaggtaatcgataaacacccgctaacagagattcatacctgcggtaaccggtatcaatataaggatttggtgaaagaactgaatgagcggatacgctcgggggaatttaaggtttctttataacgtgatgcttatcttagcttgtgccggttgaaatgcggccctgccttgaacaaaaagaaaaacgtagacaataccgtaaggcaagcgccggacaggtaggcgtagttgaagccacccagctcttgtgcgatactgcccccggccatcaacccgataccgatacctacatcccaactagttagatatgtagacgtggccgtaccccgctggttattgggtgccagattcacgaaaagcgtgttgaaagcagggaacatggttccgaacgccacgccttgcgagagggctatacctatgtagagataagaggaaaataccggattccaatgcatcaactccttgagcgccgcaagaagaaagaatgtggccgccgccaaatacatcccgagggagataacaagcgtgatccgtcctttatccacttgccgtccggagaacaggcgggagacagcgagtcccacggccataaaggtgaaataaagtccggagtttacgctgatcccgatctcagcggcgtacatcgctacataagtggtagtcataccataaggaatggagagcaataatagggagatacccgcccaagttcccttcaccaagaaaaagcggtctagggagatcggttctcgtttgaccggttgcttataaggagtcttgaccatataggccatgataaaaccaaggcttccggatagcaacgagcaggaaaagatcacgtcgtatgtgaagttcccttgcatgaacagaccgatcatcggcccgaaactcatggcgatgttattggctaggccgtaatagccaataccttccccacggcgggaggagggcaagatgtcgatcagtatcgtatttccggccaccgtcaccatgccgaaggcgaaaccgtgtacgacgcgtaaggcgataaagagggtaagcgccgtggctaccatgtatccgccaaatatggcggtgaaaatgaaataagccaccagatataagggacggcgggcgaaagtatccagcaaatatccggcgaacggacggatacagagcgccgctagcgtatagcacgacaagataaacccgatcatagacttcccgatcatgaattcttccttcagataaaaaggtaagatcggcaggattagatagaaagcgaaaaaaagcaggaaattcgccgctagtatatagcaaaagctgggtgtgacgatcttatcattattcatagagacgtgtcgtttataaatgacgcgaaattagatgaatttattgaataaaagggcttaaagtaagttttttgtacgggattgggaccgattgctgcaaatagttaatttaattcacatgtaaggcttttttatactcggtaggcgtcatcccgatcttattcttgaagaggcggtgtaaggcacgtacgtttcccaatccggaatcgagggcgatggcttctaggttgtaataaggatattgtttcattagctgtatggagtgttccatgcggaggttgccgatatagtttgtgtaattgtcttccgtgttgctctgtatcatccgggcaaaacggtttttgtccatgtggagccgttttagtacgtcctcacgggtaagatctgattttagatagagtttctctttatgcattatttcttccaacaggatgaaagaatcttggtcgattggttgatctgggtcagtttgtgtcttgctatctgatttgggaagttcttcttggtgcgatagttctgcctctttgtcacgttccttgatcgccaatagctcattcttgtaggctaggagttggtttacttggttcactgtgatcttgttctttcgcttgatgaccttgctgttccggtacgagatccaaagcaagagaataaggaggattatgatgcctagagaggctccgagaaatgtgttgcgctgcttcagctccatttcctgcttgatgatcttggtttccttttcgttcgtctcataggcgatggcaagttccatggccgcgttttccttgtcgcgggcatacagttcctttcgtatgttggagagacgatcactgtattggagagctgttttatagtcccccattaaggaataggtattctttagcttcgctagcatcaccgtataatctttattgatggaatcttgcgccggagtcagtctctcccgttccaaggtgttatggatcacttgcttataatcatttattaatagcaggtaagggtccgctctcgttcttccctgcggcttttgggcgaatttggtggtgaggaacttttggtagtaactggccgctgcttgttcctctccgatcagttgatacgcttcgcaaaggaagctatataaataacctaggtgcatatccacccttgtctcttgcatgtcgcctgtttgttccatcttttccagaagtgcctctacttcctttccggtatttattgcttcttcatttttctcctggatcatgatgtttcgtagcttctccatataaagtgagatcaacgtacacttttcttccggatcggtggtgccttgtagcagttcaatcgcttggtcaagtgtctcgatagccttgtctttttgtgccagctcgttttgtgcccgtgagatggagatcatagaggtagcctcgacgctcttattgccttgggagcgtgcgatctgtatcgctttcgttgcgtattctatggcttcgttctggcgggatagctcgatatagcaattacttagtatctggcaaacattcatgtaggccgtggagtcgttttgtacggaatcggtgtggaatgcggctagagcgtattccagcgctttcttctcgtttttcaaccgggcgtatgcccgtgaccggatgatatgtgctttgtattccggtatgatccgtaggttctcggcgctatcggctaggtttatcgctttttcgggggttgcgatgatctgattgaatatggattggtaagataatttttcttgggggcggttatctgcggaagggtttgccgctctcaagagtacgatagaaaaaaagaataaagttatatatgttagtttcattcatttactttttagcgaacaaaaatataaatttttctttgatttataagtgttttttgtgacgattagatatgaaaagggcctagtttacctcgaatccggattatatgtcacactgtttttggactaaatgtcgtaaggtagcggggtttcttaatgaaagtccgcatttaaaagccttactttgtatcacaataagacagataaaatggcgcatttaaaatgtcgtggctggcgtgatgagacgagctttacgtcttaattgaaatataatggaaaagatggttaatatgaagagaaaatctattttgttatcgctgcttctagcgatttttgtggtaggagggatgtttgcccaagaacctacgtattccaagatgtctccctatacacgtattcttttagacaaattagcgaagaaagatacggcgaactcgttgttgaggagttctatctcgggagattatctctcggctttcgtgaaggtggcgacggatgagggatgggcttccttggattcggccgggtgccgtatccggacaaggacgggagatatcgctacggtgttgatccccctgtctgccgtggagtcggtgtctgagctgggttgtatccaatatgtatccgcttcacaacctatgagggccagtatggactcggcccgttactactcggacgtggcggatgcctatgcggggactaagcttccccagccttatacgggcaagggggtcatcgtgggtgtggtcgatcagggattagattttactcacccaaatttctatgacaaagagggtaaagcgtatcgtatcaaacaagtttgggaccaaacgagtccttatagtaaagcggaatacaggacggaagaggaactgctggatgcggcttgctcgtttgattcggatgtaaatacgcatggtacccatgtcgcgggcatagctgccggaggagggtttgatacgccctaccaaggtgtggccaacgagagtgatatgatcttggtggctactaccatgcagaattctgatatcgtagacggagtggactatatattcaaggagagcgagagactgggtagaccttgcgtggtgaatcttagtttaggggatggtattggaggacacgatggtactaattttatggatataatgttggaccgaatggtcggaccgggaaaaatcatcacggttgccatgggaaattctagggacatgccagtatataccgaacagatgtcgccttcggataccttgcatacttttgtaggcaggtctaatacgggtctttcttatggactggtggatatttgggcggacgagcccggggaacctttttctgtttgcctggatctgtatgatcgcgaaagcgatgagatattaaatactaccgggtttttcgccttggatacaatgcctaagtcttctgtttttactagtgagagcgtggatggcacgttggtgtatgaggcgcaaatggaatctgaattatatgtgtttaatgggagataccgtctttttattcagttcaattatccggaaggcaccaaaaatgaaaagatattcttacttcatgtggcgacaaataacacgccggtccgggcttggggcaacaatggcgagagcttatttacggacttgggaaaagggtatccttatacggtcggtacgggagatttcactgtcggctctccggcatcggccaaaaacgtgatagctgtcggggcttatgccactcgtatatgcccggtaaatgtagatgggggtacctcttatttggcaggtaatagtttgggtgagttaacatcattttcaagcgtaggccctacgcttgataatcgcatgaaaccagatataacagcacccggactttgggtggcatcctcctataactcattctatctggagggtgagaccggtgaaggagccaaggcatcacaggctcgctattccactttcaatggacatcgatatccatgggggtatatgagtggaacctcgatggcttgtcctttcgtgactggcagtatcgctctctggttacaggcgaatcctgctttatccccggatgatatcaaggatgtcttctcccgtacggctgttcaggataaaccgctctcttatccgaacaagcaatggggatggggaaagatagacgtgtataaaggtctgctggatatattgggaatccctacctctacggagaacgtattcgaggaggctccgcaagaggccgtgtccgtatatgctagcggtacgaaaggaagtttccatgtccgttgggcggaggtccccggttcgttcagcatccatgtacatgacgcttcgggccgtcatctgtatggtgagaaggtagattctccagcctcggtggattacgctgtttccttgggaaatgtccagcccggcgtttatttcatacggatagatacggcagagggtacggtggagcggaagatacgcatataacccggactcgtctggatcgtttatagctggtagcggatcgctaccagaaactcccggggacggatacgtacccatgaggtatagctttccaacgatgcgtatcgcgtgtatccgtaggtacgtttgtcgaacaggtttgtcgccgtggcggtgatttgcaaacgccgggatttccataagaccgagaagtccgcgaaaacggcgttgacggattggtcttcattcacgtcattgtgataatgatctacggaaaggcttgcctctatgggtgagaaaatgtaggagagttgtacttgttgggtgacgttccataagggcgccaaacgggtacgttctcctattttatttcctccgtaccggatatcggtttggtaactggtttcccaatggcggttgggagtccagatcactttgggctctaggcgcatgaggcgatattgataaggaagcctttgtcccccgctgatttgctcggccttgctgatattgaggagcgccatgagcgaggtctttagccctagatcgtaaaagcctttggatagcgtgcttttgacggtatagccggaaccgtggttggacagcggtaaggagactcgttgtacctgcccgttctctatacgttgctcgtatatacgattgtaccactcccggttgtgtgtcaggtttaccgtggcgaagaattcccgtgctgtactcttgtattccccataaacggaataaagctgttgtctgtaaaccgggaggattccgcaattccagacgctattccggtaatccgtttgataaggccggtcgtataagtcggtcatctctccatatctttccttataggaggcgtgtgccgtgaaacgccatgcgtaattcagtttgtagataatagacagggacggattaaccgagatgcgggagaaaccgacccctgtatatccggtccatctgagtggggagctgagggatagggtccatttataggtattccattggtaatcgggtgagagataagtttgcaggcttttcttgatattgctgatctccccgcttatgcccaccgtatatcgctgggtgagggaaccgctctttttcaggaatgaaaaggaattatcggtataaaagtcgcgtaagctcattggataaggatggttatccaagcgaagatcggccgcgttgctgtggtaacggagcaaagactggacttccaacgtgtatttgtccaagctccacaggctccgtaaattattacgtaagttgaggttcggggttttgatgcgttggtccaatgttgtacggccggtggaaattgtgtttccggttatatgggaaaggctggattgccaatctccggtggctgagaactggttcttgagatacctttcctgcgagttgttttccactccgatattgaggttggcttgatccgagcgaatgcggctatcgctttgctccgttagatgaatcgtgtcctcggattggtaataagtcgtctcactccccctttcctgtgttcgcaggtcgtggatataaccggcgtttatacggagttgggtgttctcgttcagtttatataggcgatttgcggataggctgtgtatatggttgaacagccagcgctctttctttagcggggcggagaatgagggttgtagcagaaattggggaaccttgggctcggataaacgggattcgggtgattcggtaagcgtattttgctcgcccgatacatcttgcccggtattattccctttatatagataagcggattggctgctgcggctgatctgcaaggcgtcagcggctcctttccataagaacggggatgcgccgagaccgccttcggcattgatcagccagcgatcccggaattccggtctcagtttgaggttcaacgctacgtcttcggtcttgatctttctctgtaacacacggatcggttggtggttctccatcacttgtatgttctgtacggcgtcggctcgcaggttctcgctgatttgcttgtatttcccgttggtgagatccagtccctccacatagaaattacggatctctttcccgttgtaagagatcttccccagatcatcgatatcgatacccggaagtttccgtaatacgtccttgatggattgatcctttggggatagaaagcgggtgacatcataattgatcgtatcttgctgcccccagacacgtcccggacggatttccacctcctttaggctgaatacctgcggctccatctcaaaacgaagcgtttgtccggcatgtacggcttgttgctgggtttggtaccctaagagcgagacggagacgagaagtgagtccgtccgcttcggttgggtgagggtaaaggtcccttcattattacttaacgtatagttgatcggaagggagacgttgcctctagttaattgcacggtggccgcttctaccggcagttggctttccctgtcgatcacgatccctcggatgacggattgggcggccaatcctgccgggcagagcagcgtaagtaaacaaaaagtgtgtatatgcagtatgatccgtttcatctttcttccctttctatagggttatacggcatgttcttgggttggtaaggtttcccgttatcgtcggtgacggtcactttcacctgtggcgaggtcaaggcgatgtatccgataggatcggcggcatatcgttcgtaaaccttttgcaggttcttgcggctgatcggctcgaaatcgtttcccccgaaaaggatcgggttcttatcccggctcagttcgatacccgtgcagatgaaagtgtaatgtccttggctgtcttgggcttttaggatcaggcccggtaatccgcataatttccaaggaccctcgcttttcggtatctccggcgtgtaccaagcctcataatgcctgcccttgaaatgacaggtcgctttccggcaaggataggacaggatggtcatcgtatcgggcagtaaggtccattccgggcgctcctccttttcctcgcagcgaaagcgactggcggcaagggcatccaaggtcgtggtctttcccgccggataattcttgtagacctgcgcgttggtcttggatgaatattgttgcaggtgttcattgatgacttcttgtgaggctccggcggctttgtcggcctctagtacggaatcggtgaggaatttggcgtaactatagtaaacggagcatttatccccgaccttcagcatgagggtctcttcctctttcttgtcgggttggagcgtgtccggcatggacgtggtctggtattgtaccgtgaaacgtgtctcgtcgatgggcttggctcttagtacgtcgtttaggttgaagatgttgattgtcacttgggcgttcgtctcgtgtcccgcccctgacagacctacgcaaagcaggccgattgtcgctatgattcgtttcatgatctgttggttttagaagttatttgtcgcgaatgtaagagaggaacgtttaccgtaaggaagatttttattactgaaatattactccgcttataaaaatggctacatgtacgttgtaatcatggagtagctatctatctttgccggaaaggaataagatatgggaaagaggattcgatggatatgggtaatctcgttggcggcggctttggcggcgatcggggtacaaggctattggttgttcaatcagttccggtatgagatgtgtacttatgcggatgagatcgccggtgaggtatttcatgccgggcaggaggaatttcgtatgcggaaggaagaggcggagatgacgaaaggtacttatattatagaacgccagtcgaaataccagtctggtgatagcgtgttaaacgggttgaaaaactcgttcggtttccagctttatcccaaggatacgacaaagatccatagttttcggcttcatctggacccgaatatgccggaagatagcttattagttggggtagatcgttcggtcgtggagttcttcgtgcctttctccgcggagcgtttggactccatcttgtctgccggtctgcccggtctggattatcgggtacgtccgttcgtagcgggcgataccttgtccgggcagtcgtcggccttatggttgccgttatcgaaaaaactgctttcaacctctatctcgatatgctatttgttcgccccgatcgagagaaaggcggtgtgggtggatgtggatcttcccatgaatccgttattgggccggatgggatggcagcttttcctaagtattttccttatcttgttattgctggcttgtttgggtttccagatccgtacgatctgggagcaaatgcgcttgaacgagttgcgtgaggggttcgtgcatacgatgatccatgagctgaggcgaccggtacaaaccttgaaggtattcgtctctttcttgaatgaccgggagatgcggatggatgaggccacgacggaacgggtccttcaagactccatgttcgagttggataatctttccgcctatctgggaaaattgaaagatatggtctgtgcggacgagcgggagacgcttctgagaccttccgcttttaatctccgtgagttggtggagaaggtggtacgcctaaccaatatccccaccgggaaaaaagtctctttctcgacggcctttcccccggatatgccggatctgacagccgatccggtacatgtggcgaatgtcttgtctaacttgatagagaacgctatcaaatattcgggagaggaagtgaatatcgatatcgtagtgctttggaatcagcaaggggtgggattgaccgtttcggataatggcttcggtatcgctccggatgagcggcgaaaggtattcgagaagttttaccgttcgtctcatctgccggataagcaaattccgggtattgggttgggattgagctacgttcgccaaatagtagaggcgcatcatggttcagtatccctgcgaagtgaattaggtgaaggcactcgaattactataaatctacctactgcagctttatgaaatcgacattgaaaatacttttcgctgacgatgactttaagtattccctcgtcttgaagcgattcttggaacgggaggggtatgaggtgacttataccggcaatggtaccatggctttgaagcaattcccggtcgtgaaaccggatctggtcttgctggatatcaacatgcccggcctaaacggtttcgaggtagcggaaaagatccgtgagcaagaccgccatgtcttgatctttttcctttccgaccgttccgataagaacgaccgtttgaaaggttttagcttgcgcggaaacgattacttggcgaaacccttctatccggaagagctgatcgcccgtatcaaggaccgttttgagatcggtgtccatgaaagcgtgcaggaggagagcttccatttcggaaacacgaccttcaactacaccacgaacgagatccgtacgggtaataacaaggtattgatcacttcccgccaagcggatattctgcgaatcctggcgacaaacctgaatctggcggtggatcgtgaccttctgttggaaaccgtctggggaactagctcatacgccaactccctggccttgaatgtgcaggtcacctatctccgtaaagcgcttcataacgatccgtctaccggcattgtatccttgccgaagaaaggatatatgctaagaggatagaatttatccggtagaattgggtttctgatccgtaagcattatctttgtcccacaaagtattcacagaaagaaaatgaatcatatatgaacttcagcgaacaatgtttccgcatttttgagcaagctacggaggcttatcatgtaactgacaatgtagatgctacagtgcataatccctatgcggtaaaaagcatcgagttttatctttatcttaagaactggatcgatgccgtacaatggcatttggaggacattatccggaatccggagatcgacccggtggaagcgctggctatcaaacgccgcatcgacaagtcgaatcaagatcgtacggatttggtagagttgatcgatagtttctttctggataaatacaagaacgtgaaagtcttgccggacgctacgatcaatacggaaagcccggcttgggcgatcgatcgtctctctatccttacgctaaagatctatcatatgcgtgaggaggcaaaccgtccggatgctactgccgagcataaggctcgttgtgagcagaaactggcggtgctgatggagcagaagaaggatttgtcgatggctttggatcaattgctatccgatatccgtgacggtaagaaatacatgaaggtctacaagcaaatgaagatgtacaacgacccggccttgaatcctgtgttgtacggtaagaaataatggcaaatatattagtaatacgactttcggctatcggggatgtggcgatgaccgttcccgttatctattccgcagccaaggcgaatcctacggactcgtttaccgtgttgacgcaagcgttcttgatcccggtttttatcaaccgcccgaagaacgtgaacgtgatcggtatcaatacgaagagcacggagaaaacgttggcgggattgcttcgttttgcctctgccttggtgaaatacgatttcgatatggtgctggatttgcacgatgtgttgcgaaccatgattatccgtacgctgttccgcttgaacggcagacgggtgtttgtcgtggataaggcccggaaagatcgtgcccggttgaccgacgcgaagcataaacgatttaaacaacttcgcccggtgatcgaacgttatgcggatgtgttccgtaacgctggacttcattatacggaatcgttcacctcgctttatgagacctcgacccctgatttatccgccttggaaccccttgcgggaacgaagacgggcaaatggatcggtatcgcccccttcgccaagcaccggggaaagatttatccgaccggggagatggagctggtcatggccgagctttccgatcgagaggattttaccatcttcctgttcggtggtcgtggctacgaggaggcgctcttggatcaatgggcttttgagtatccccgggtaaaaagcgtggcgggcaagtattccttggatcaggaactggccttgatcagccggttggatctgttgatttgcatggattccgccaatatgcatttcgcttccttggtcggtacacgggtgctttccgtttggggcgctacccatccctatgccggattttacggatatcatcaggatccggaagattgtatccagttggacttaccttgccgtccttgttccgtattcggccaaaagccctgcctgcggaaggattgggcgtgtatgagacagctcaatccggatctaatcataaacaaggtattaacctctttaaatgaaatggtttcggatgaaggaggtcattaacccggcgtacgggcgattcgaggattttgtaaggcgtgtacctcgtatattttcggaagagggaaaaacgatttataaggcgaggaatgagatcaaggtttttgaggtagatggtgtggaactgaatgtcaagcggtatagaatccccctcttgataaaccgtgttatttatcgttttttccgtcagcctaaggctgtgcgagcctatgagtacgctctgcgattggttgccaaggggtttgagactcctgccccgatcgcttatgtcctttttcgggagaaaggccttttgggatatagttattttatcagtttgcaatccagctataagacattgtataaagtcggacagcgtccggtagaggagaacgaggatattttccgtgcgttaggtacttatatggcaaagttgcatgaggcggaggtttatcatgccgatttctctcccggaaatgtattgtacgatcgtacggaggaaggggttaagttctccttgatcgatataaaccggatgcacttcgggcctgtctcgctgaaacgaggatgcgcgaatttctcccgtttgtggggacgggaagccgcttttcgtttaatggcagagacctatgccgagagccggcattttgataaagcggaatgccttcgttggatattatactatcgaaatcgtttctggaagaaatatgcgttgaagcatgagattgaatttgaattatagacttttatgaaaatacaaatactccggttctgtttagttgttagttgtcttttggcctatgtatctccggttaaggcgttagaatggtgggaaaaggtagagtatctgacttactcgccccgttatttcgggccaaatgcctttccgattcccgagttggtaggaggaagcctgtccagccgttgggaagtggagcttcggggggaatatcataagacgcgaggcgatcagacgaaagatatctttacccgtttgtacattcctgtcgtaaagggacgtgtaggagtgaatgtcagttgggtattccaagaatggtatgagatgtcgccggaagtgcgggatgagcgttatgcggtagaactgaaatccccgattgtttgccggggcgacgtgatctttaatttttatttccaagccctccggagcgagaaatggatggatatcgtggtaagcgccaacctgaaaaccgccagtggcggacgcttgtgcgacgctcgttatacggatgcggcctcttattggttcgacgccaatctgggacgtacgttgtggaagcggaaagatgtaaacgcttcgatccgtgtgcaagctttagcgggtttttattgttggatgactaacgatgtcgttaatcgtcagaacgacgctttctgttatggggcaggtgtgtcagggacctatcggggggtctcgttggattgtaattatgccggtttccggggatatcgggataatggggataagccgatgattctacggacaaagctaaattatgagcttaagaaaaatatcctgtccttccaatataaacatggaatgaaggaccatctttatgatagctattcattagcttatatccgttgtttctgaatctgtaaataatctatgctttcttgatcgacctgaataacgtggcgaagccgtctgtataagcctttacgctgaaatcttggatgatatgctcacgtgaggccttggcgaacgcttccaatcgctccgggttatcgataagcgagcggatagacgccgccatttgttgaggagaagaaggcggcactaacaatccggtgactccgtctatgattaagtctcttgctcccggtatgtctgttacgatacaaggtactgaacaagccatagcctctcgcacgactcttggggaggcatcccggtgcgagggaagtataaacaactgggacgtgaccagaaaagagatggcgtcggaacgctgtcccagaaaatgaatttgtgcgcttaccttcgactgttgggctaattggaaatcattttccccatattctcccacgattgtaagatgtacccgtggatcatccaataagataaacgcatcaatcaaatcggttaagcctttgaacggcctgttcttcgtcgctccgatatagatgcaacgaaaggcgtcgtccggaatatcgtctgcttgtttgggcgtacggactgcctccttgatccaatcgatatcaaatggctttgtgctggtcgttagtctttttcgtgcgatgaatcgggagagatattcctcgatatctttggtctcgcatacgacatgctccacggcgggatttaatatgcctagataataggtcggatcgaaccgcttcaatttagcctgcgtacctcggtatgcgatattcttcgcccgtgtgcctatggaagcgaatagagcgtttgataaaccggaactactcggtgagtagataaggtcgatccgataagtcttgatgattttgcgcagggcacgaataacgttccagttgaacttcgaggtaatgaccggcagatccaaaggtgtacaattcccatagatatttttgtcggtatacgattggggagaagcgatatagatgttgaagtcctcaagcttggacaatccttccagcattttgtaggttgctatatcggcttctttatagactaaaagtatattcattgtgtatggataaaatggatttgctaagatcgtgagatattctcgtatactcgcatgaaatgagccgctaatacgtcgggcatgaatcgccgtatattctctcgtccgccggaacgcatggattcggccagcttcggctcgttcaatacggactctatcaagccgcgcagttcttgttcgtttcttggatcggtatataaagcggacggtccgcccgcctcttccagacaagaaccggtagccgctatcaccggaataccggcaagctgggcttctaagatcgggataccgaatccttcgaaaaacgagggatagacaaataaggtcgccatctgatagaaagcggctaattcgttaaaaggtatatgagtcaagatatggacgcgaccggacaggttgttttcccggatataagtctctaccgtgtccgtataaggcgtatgcttaccgatagcgatcacggagatatcttctttcagctttttcagggcttttaccagaagcaataaatttttccgttcctcgatgctccctacatataatatataaggcccgtttatctgatatttctcgcgtacggacgatttcacgtcttcttgaaccgcttggccgaatatcgggtcacaaccttggtaaacaacctcgatcttgctttccggaatgtggaagaagtcccggatgtctcgcatcgtctgtcggctgatcgctatgatcttgtccgaccgtaaacaagcttgcttgaatttgtaggtatagatggaacgatcgatcggtttataaagctgcgggtaacgcaagaagatcaagtcatgtatcgttacgaccgctgggattccgttctgttttagattcataggaatctcattactcaagccatggaacagatctacgtgctcttttcgaagcgtagccgttaggcccgaggtacgccataaagacggaaatagtttatcgaacctgccttccggataatggaatgagacacttggacgctcctcgatccgtttccgtaacacttctttgcctttgcccggcgtatagagttgataggtatgctccgggaaagaagcggacaaactattcactatgaaccggctataattacccagtccggtagcgttatgcgtaatccgttttgcgtcgaaagcgatcttcataggcttgaattcgatatattgggcaaatatacgatataattttaattacctttacctcatttccttccgaaatccgccgggatctccccccatacggatgtttcccatttgaggatctgggtggtataggtatgggtgttcaaccatttctcggcccgctcgatgaggtcgaagataggttcgttgatcggtttacgtgctaatagggttttgcatttctttttcttgacccagctgatggcgttgcggctatccgaatagatcggcaggtcgcttcccttttgctgtagcaaggcgaggccgtgtactaaggcgaggaattccccgacattgttcgtgccctccttcagcgggccgatatggaagatctcttgcccggtagcggtataaacgcctctgtactccatatccccgggattaccgctacaggcggcgtctacggcaagactctcattgatggggttcccgatcggggcttctggcgcgagacgggccacggctttcggggaagaggcggtctttaggtaatgggtatagccggcctcgaaggctttggcggcttcctcccggttctcgaaggatttatatttggctccctcttgtccgtctacctgtgccttgcattccgcccagttatcatagattcccgggttcaaccctttccatacgacataaaacttattcttggccatgactcttactcaagatttcttgtgagaattgcgtataggtaccgaacggcgctcttttatccttgaagaaacggatcaaggcgtccagccttctttccatgccgcaaccggaatggttggtcatgataaacggcaactttagctctttccggtcgctcaaggaggtaaacttccacggatggaaataggtcaggaaataaccgtcctctttccaagtccaaagcgctaacttacggtacaaggtggccggaaggttatggtaagccagccaaaacaaggggaaacggacgatcggggtcaccgaggcgggcagttgcaatacgccatctttcatgaaataggtgcggggttgccccagatggttataacggccgggaatacaagtcgggttcaaggacgagttgtataagtaaccggccttatggatctcttcttcttcgacgggcatcatgcgggccatacggaaaccgttcaccggttgtccggtcagttcctccaatgcctctttggacttgcgtagatcggcggtctcgaacgacgagtgataaaaaccatgcgaagcgatctcatgtccacccttttggatgtccaagatcaaatccttcgcatgaagggcgaagttcgccgtgcaaaagaaagtcgcttttacccggtgacgggccagacatgccaatatcttccgggttccttccacggaagtacgcatttgttcctcgaacggcaattccacgccgtgttccaatggagcgtcaaactcctcgatatcaaaactaagtaatatcatgaatgttaattaatctctatgaaataagatggataagaagttcaacgcttcccgccgcaggaccttgaatcccatatcggataccgctagtccttctttgatgttcgcattgatcgtccgtaagtttatctctttccggcgacttgccttatagataaattctgtatcgaacaggaagctattgatacgggtggtcaggaatatcgcttgtcccgcttgactgaatcctttcatacctccttgcgtatccttgatcttgatcctcaaaatccatgtgttacatatatgggatagcttggatagcacttttcggaaaggaggcaaattctcctgataacttttgctacgggtagccacgaccacgtccgctcctcctagcaacgtctcgaccatcctgccgaacgagtcgtttgtataagggaaatcgtagtccgtataaataatgtagggagaggtacatcgctttactgcctctcgcaaggcatatccttttcccctgttgggcttatagtctacgacgcagacattcggtatcaattgccggaggcggtcaatcgtttccggctcgtatccccgtctcgaaccatcactgacaataaaaaggtggaaacgtaccgggctgaataatcgctccacttcgcggaaatgggtggctactcgttcctcccagcccgaaggcgggttgtaacaaggtaataccaaatctatgtctgctcgtgcgttcattccatttatacctttaccggattataactcctcgtacacatctcaaatgtcagctttagccagatcagcatacaaggcaacgcttttaacgcatacgggtatacataatgcactcgtatgtatttcgggaaaagatcggacggagacatgctggtcaatataaaggcgaagaccatcaagacaatatccaatgtcgaacgtttccacggtacagccgtataccaaatagcgactccgataaacgctatgatataggtactggactcgctacccgtgctgaacagtacgacaaacatcgacaccgaggccaataacgttttccggaaagcctcatatttatattgactgatgcgtagataaggcaggccgaatactattaatccccctattatcagataaatgtccgagtaactgaccgatcccgatatcttacgaaccattcccaagaaggaaatgttctgcatgagcgcaaataagttctccgaattttttccggataagtcctcgaaccaaccggtatattgggacattatataatccggcccggacaatatcatcggggctacgaccatgatgaccgcccatcctacgcaagataggctaaacttcatcttatggcgagagaaaaagaagaatgccaatcccgtgatcccatacaatttagtaaaggtacccaacatgatcacgaaagcggcccatacgtctttctctttctctatcaatgcgtaggcgaggacaatgatagcggcgatactgatattaaattgcgacatgaaaagcgaggtaagcaactcgtgggcacagaaccaatagataaagatacgttcccgcttgatccccggcagcatcttgaccgcccagaataagaaaaggctttgcgccaccgaccaagtgagcagtcctaaccataacggtgtaatggcgaacggagccactaccaagctaaataccggcccgtagtgaaaaatgtcgttgtattcttccggataggcggcatagagcggcaattcattcaacgtatgccaaaaggattgtctgaagatcgagaagttgttatatttcccggggaaatacttggtaatccatgcgataacccccagcaatgtccatagccccatcaaggtactatatttgctgaagaatggtttatggatgatcgtattgaatttatctataaatttcatcatcgaatctctatctgtctacggggcaaaattacataaaaacggtgacttttatgcgagttaaataaaaatactatttttgcgtccaaaactggtaagagattatttatgaatgaaatgttgagatacacgatcattcgtgtcattctgtttgtaatgggaggctttcttgttctcggatgttcggatgaagatgatgtggataatagtggaggaacgagtaaatatggtttaatacggatggcggaggaggattatgattcgtcgaatacttcttatatccttcgggatgaggaaccggacgaggttcttttcgattcgtcaaagcgaaaattcaaggtgaatgagcctttgcaggtgtcagttaccgggcagaaggagttgatgcttcgtttctattctcctagagctatccataatgtgattgtctgggctacggttgagggttgtgaggatgaggtacggtttgcggagtttactacggttttaccttttcaggagtttaaaatgaagctgccttttctagaacgggcgaaggtttattatacacgttccggcgaggaggttaccatagatgcccatccggatatcgtggccgagaatataagtttgcgggttgaatgtggagatccggtctatcaaggaatgataaacgtgaaacctaagtgggatatttggtttggtaaatattctggttcgaactggggcaacttcaggccacatctggctcgtgaggcggttgccctttccttgaatatggccgcgatgttttcttcctcgctttttgatgaggaactggagaagtggcgcggcaagctgataaataacgagcaaatcgtggatatagatgtgttgaagaaacagatcacgaatcatggcgggttgtgttatggacgcgtggtgaatgttgtcggtctgggtggaggaaatacctttgggctaggtgaatatgtctatctgacccattatgccgacgatgccaatggttctgacacgccgtatcatgagctggcgcactgcttggggtatgggcatagtgggaatatgacgtactatccggcggaaggcggtttccctacaatttgtatgaaggtttactcacagctttccgtgagcaagaaattaccggtttattcccgccgtttcttgcatacccggaggaataagaatctggtagagaataaaaacgtgtatacttcctcgaaatacattatcgatgatccggaattggatgccatagatggcgggcttgggcttgctccgatggagacggatagggctggtgatgagggttctcctctctcatttacactttctgtcttggatattcccggtgccactgtggaaacttttcatccgaaagcggtccatctttatgggaatacgctatatgtagcaaatgacgctccgggacattatagtttggaggtctttgatgtatcttccggtaatgtgcgtcatgtgaaaagtatggttgagtggatgaacggagataagaaagagacctttgcgggggagccaaacggcgtgactcgctcgtatgggaaaatatatgtcacgaatacgggaagccgtacggatgtgtttgatgcggaaacgtatgagttcattacttgtatcggtacgggtacttggggtgagggtggttatcagaccgttcatgcgtttgatgtgacggctagtcaaggggctgtctttatccgggataaacggaaactggtagttgtcttggagcaagatgtacagcccggttccgctgctcgggtacctatatatagccgtagcgtaaatttacaagaggcaatgggtacttatgcagtagcggcacgaaatgatggctttttatatgtgacggcccagaataaaaatataatctatttattcgatcctgcggacattcgggcaggggacacgggctttgcgccgtatctggtgacattgggatttgaaaagtctccccagtcgatagcgtttgtaggggatcgtttgtttgttacgcttcgtgtcgatgataaacggtcggagctatgggagatcagccctaagaacggaaaattattgcaggactttactgattcgatggtctatcccgagaaaatagccggtgctcgtcatactttattggtagtggatcgtgcgacccagacagtaaaagccattggcctatgatttttttattgattcttaggaataaagaagatggagttcccggaaaaagtttacatttgcgaaaactattataataacgtatgaaacgtgtttttttggtcggatatatgggagcgggcaagacaacggtgggaaaagagcttgccaagctcgccggtctttcgttcatagatcttgattactatatcgaagggcgttatcataaggccgtttcgcagatattcgccgagagaggggaggaggctttccgagagatagaacggaatatgcttcacgaggtcgctgagtttgaggacgtgctgatctccacgggaggaggcgctccttgctttttcgataacatggagtttatgaacgcttctggcacgacggtttacttgaaggtgtcagtcgaggagctggcgaagcgtctggagttgtgcaaacatacccgtccggtgttgaaaggacgttccggggaggaactgaaggcgtttatcgccgagagtctggagaaaaggaatccgttttatacgaaggcgtccataacgtttgatgccgagaagatgttaacagaatctgatgtacatgacatatcgaacgcgttaatgaaaatcctatagcatatggaagcgaacgacggccggcaggcacagggggcctatatcccgcaggaattattgaaagagatcagcaaggtgaataaccgtttgctcatcggtattcctcgtgaacgatgcgaggcggaaaaacgtttgccgttaactccggaggcggtggatatgctgaccgattgcggtcaccgggtgctggtggaaagtggcgccggattaggtatcaactattccgataatcatttctcggaggcgggggcggagatcgtcgatacgcccgcagaagttttccaagcggatctgatcttgaagatattgcctccgttgccggtggaaatcgcacttatgagacctcgcacgaccgttttctcattggtgcagtttaatttattcgctcaagaggctttcgagttgatgatggcgaaacggattaccgctatctcttatgagttgatggcggatgaatataatcgtttcccggtgctgaatgtcacttccgagatcgagggggcggcttccataacgatcgcttccgagctgttgagcaatacccaaggaggtaaagggatcttattaggcggtatcccgggcgtatcccctacagaagtggtgattatcggggccggaaacgccgggaccgtggccgcgcgtgccgcgttggccttgggagcatccgtgaaagtattcgatgatgatatcaataaattgcgtataatacaacaggtcttggggcaagggctttttacttccacgttccatccgaatgtgctgcataatgcgtttcgtagcgctgacgtggtgatcggggcgatgcgttatattaatacgagacatcgctatattatcgctacggacttggtgcgtacgatgaaaaagggagctttggtgatcgatctgagggtaagccaaggcggttgctttgagacgacttgctgcttgtcgagggaagatcctgcggtgttcgagcaatatggggtattacattattgtaaactgaatatcagcaaccgggtggctcgtactacctcgatggcttatagtaatatattcgtacctttattattgtcgttgggcgacgccggttccgtgcaaggaatgatcaaatcggataagggctttagggcgggagtatatatgtattatgggaagacagtgaatagttatgtgtctaaccattttaatctatcatctaataatcttgatctatacctctctgctttttgatgcggaaaagttttgaactcgcaaagtttatgctttactttgcggacgatctaaataccaataagcgataaagctaataaagtatattatggcagaacagacaaaagttaagacgctggagaaggttgtaattcgtttctcgggagactcgggagatggtatgcagttaaccggtacaatcttttcaaacctgtccgcggttttcgggaacgagatttctacattcccagactatccggcagaagtacgtgctccacaaggaacactaagtggtgtatctggattccaagtgcacttgggatcgcgcaagatcttcacacccggtgataaggccgacgtattggtggccatgaatcccgccgcgctgaaggtgaacgtaaaacacctaaaacccaatgcgattgttttaatcgacacggactctttcaagaaaagtgatttggataaggccttgtttacgaccgatgatccgtttactgagctgggattgactggcgtgcaggttgttgccgctccgatctctacgatggtaaaagacggattggttgagtttggtttggacaataaatcggctcttcgctgtaagaatatgttcgccttaggacttgtttgctggttgttcgagcgtccactggaggaggctatgcacatgttgcagaataagttcgctaagaaaccggttatcgcccaagctaatatcaaggctttgacggacggttataattatggtaataacatccatgcctcagtttctacgtatcgtatcgagagtaagaaagccgagcctggattctatacggacgtgaatggtaataaggctacttcctatggtttgatagccgctgccgagaaggctggtttgcagttgttcttgggtagttacccgatcactccggctactgatattttacatgaattatctaaacgtaaggatttaggcgttatcacggttcaggccgaggatgagatcgccggtatctgtacttctatcggagctagtttcgccggttgcttggcggctacatctacttccggaccggggcttgccttgaagagcgaggcgatcggtttggctgtaatcgccgagttgcctttggtgattatcgatgttcagcgtggcggtccttctacgggcttgccgacgaagagcgagcaaacggacttgatgcaggctctgtatggccgtaatggtgagagccctgccgtggtaatagcggcctctacgccgactgattgttttgatgccgcattttgggcgggtaagttggccgtggagcatatgactccggttatcttgttgaccgatgcctttatcgctaacggttcttccgcttggagaattccggaaatggataaatatccggagattaagccgaattacgtagctaattatcaagacgagaaagtctggaaggcgtatcgtcgtaacaaggaaagcttggttcgttactgggcgattccgggaacggaaggtttcgctcatcgtctgggcggtctggagaaagactacgagacgagtgcgatctctaccgatccggctaaccaccagaagatggtgacgacccgtcaggctaagatcgataagatcgccgactatatccccgaactggaagtgatcggagatgaggacgctgatttattgattgttggttggggtggaacctacggacacctttacgagacgatggagacgatgcaagagaatggcaagaaggtggctttcgctcacttcaagtttatcaacccgctgcctaagaatacggctgaggttctttctaagtataagaaagtggtggtggctgagcaaaataacggccagttcgctaactatttacgtggaaaggtacccggatttaacccgtatcgcttcaatcgtgtaaagggacaaccttttgtcgttgcgagattagttgaggaattcactaaaatattggaggtttaaaagatgacaacagaagaaactaaatttcaaccgaaagattataaaagcgaccagtacgtacgttggtgcccgggttgtggcgaccatgcggtactgaattgcctgcataaggctatggccgaggtaggagtggctcctcacaatatggcagttatctcaggtatcggctgttcttcccgcttaccttattatatgaatacgtatggcttccatacgatccatggtcgtggagcggctatcgctaccggcgtaaagacggctcgcccggacttgagcgtatggttgattacgggtgatggcgactgcttggctatcggcggtaatcattttatccacgctgtccgtcgtaatatcgatttgaatatcgttcttttcaacaataagatctatggtttgacgaagggacagtactccccgacatccgaccgtggtttcgtatccaagagttctccttatgggacggtggaagatccgtttatcccggccgagttggcgttgggtgcccgtggtaatttcttcgcccgtacgattgacgtggatttgaagaatacgaccgaggtattgacggcttccgcccgtcataaaggcgcttccgttacggaggtattagtgaattgtgtgatctttaatgacggtatccataaaggtatcgtagacaaggaataccgtgcggatcgtacgattttccttcgccatggcgagaaaatggtttatggcgctaacatggataaaggtcttgtgctagatggcctaaaactgaaatccgtaacgatcggacaagatggttatacgatggatgacgtattggtacacgacgcccatgagaaggataacaccttgcatatgatgcttgccatgatgagcggtgatatgccaattgcgttaggcgtaatacgagatgtggagggaccgacctatgatgaggctgtccaccagcaaatcgaggaggtacaagcgaagaatcctacacgtaaattacacgaccttttgatgaaaggtgagatttgggaggtaaagtaatatatttctgattggatataagagaaggcgcaagatatttatcctgcgcctttcttatatttatacgctggatttgtttgtgcggaaaaaagtatatatctttgtttcagtcacaataaaagcgaatacctatgatgacaacttcggaaatagttgagatgctagctaaaagtatatgatttgtaaactccatattacaaatagactaagggttttgttaattgcatggaaaagagtaattattactgaaaaatttccttaataagctgtgtacgataaaaaaaaatattacttttgtaccgcggttaacaaggtggagtcgcagcaagctccaaaaggtcggaaagcctcaccgtatcgaactagagtagagagaaaagttatataaagtcaatcatttaaattaaattcaagatggctaatttagatttaagcaagtacggaattgttgatgtgaaagaaatcgttcacaatccgtcttatgatgttctgttcgcagaagaaactaaaccgagtttggaaggcttcgagaaaggccaagtaactgagctaggtgctgtaaacgtgatgactggtatttatacaggtcgttctcctaaagataaatttttcgtaaagaatgaagccagcgaagattctgtatggtggacttctgatgaatataagaatgataacaagccttgttctgaggccgcttgggcagacttgaaggctaaagccgtaaaagaattgtctggcaaacgtttgttcgttgtcgatacattctgtggcgctaacgaggctactcgtttgaaagtacgtttcatcatggaggttgcttggcaagctcacttcgtaactaatatgttcatccgtccgacagctgaggaattggctaactacggcgaacctgatttcgtttctttcaacgctgctaaggctaaagttgacaactacaaagaattaggcttgaactctgagactgctactgttttcaacttgaagactaaagagcaagttatcttgaatacttggtacggtggtgagatgaagaagggtatcttctctatcatgaactacttgaacccgttgcgtggtatcgcttctatgcactgctccgctaacacggataaagagggcaagagctcagctatcttcttcggtttgtctggtactggtaagactactttgtctacggacccgaaacgtttgttgatcggtgacgatgagcacggatgggataacgaaggtgtattcaactacgagggtggttgctacgctaaggttatcaacttggataaagagagcgagccggatatctacaacgctatcaaacgtgacgctcttcttgagaacgtaacagttgccgctgatggtaagatcgatttcgctgataagtcagttacagagaacactcgtgtttcttatccgatctatcacatcgagaacatcgttaagccggtttctaaaggcccgcacgcaaaacaagttatcttcttgtctgctgacgcatttggtgtattgcctccagtatctatcttgactccggagcaaactcaatactacttcttgtctggatttaccgctaaattagcaggtacagagcgtggtatcacggaaccgactcctacattctccgcttgtttcggtgctgctttcttgtcattgcacccgacaaaatacggcgaagagttggttaagaagatggaaatgactggcgctaaggcttacttggtgaacacaggttggaacggtagcggcaaacgtatctctatcaaagatacaagaggtatcatcgacgctatccttgatggttctatcaatgaggctccgacaaagaagatcccgtatttcgacttcgaggttccgactgcattaccgggcgtagatccgaagatcttagatcctcgcgatacctatgctgatcctgctcaatgggatgagaaagcgaaggatttggctgctcgcttccagaagaactttgctaagttcacgggcaacgaagctggtaaggcattggttgctgctggtcctcagttataattgcttaaaaaaccttgatcaaaaaaggtcaaggtttaaaaatatctttataaaaaagcgtggaattactaattctgcgctttttttatgataactacgttaattttattataaatgtaaagtagttaaaaaaaatattcctacctttagaccggattatctgttataagaagagcttaaaaaggagtaatgataaaaaaactggcacttattattggctttataatttgtttgtcatcttgtggcaaggattatgtctatcggattgaaggggaactttctaatctggaaggtcaaaccgtatatgctgtatttgagaaggataattataaagtggttgataccgtggcttgtacgaaacccgggcagttccagatcgatcaaaatgaagcgggtttccattgtgtgactattttctttgcagataaagagcattgggttacggcttatctggaaccgggagaaaccgtaaaaatcacgggcgacgctaactctccattgctattgcaggtaaaggggggacggacaaatgataagttgaccgcttttaagaaaaaaatcgctcctttattgacggaattgacaaatttatcaaattctttaaatagcaaggatttgaacgatacgatcgaggagacggatatcgccgctcgtttggcgaatgttaatatgcaattgagcgaggaagcgatccggtacgtgaaagagaacccggatgaagaggcatccgttgtcttgattcaatcttttttctcagatcccgatgatactcgtaaaattgatgagttgttggcgttattgaatccaaggttgaaagacttttatctggtgaaggagctggagcaatatagcgcccgtgcgaaacgtacggctttgggtgcggaagccccagatttctccgtaaggaatatttatgggaatacggtaagtttggattctttcccgcagaaatatttattgctgacgtttaccgctccttggtgtgatatgtgccagacagaggatctatatctggataaggtagcgatgaaatatccgaaagatcagttggacattcttttggttagcttggacgataatccggataatgtccgggatgtactgaagaaggatagtatagcgtggaacttggtaacagattcggccggacaagcggctatgttgatagatctgtataacgtaagcgtattgccacgctgtttcttgatagatgaggatcataagatcttgatgaaaacagagaatggaatcgagatcaagcaaacactggaaaacttgttcgaagactgagcgattgaaaacaggaggttccggttttaatttgtaattagtaactcaaaattcttaactatgttagtaaaatcttatgccgctgccgtgcaggggatttccgctacggtcgttaccgtagaagtgaactgttccaaaggtatccaattctttttagtcggtcttccggacgtggccgttcgtgagagccatgaacgcattatctcggctcttcaagtatgtggttataaattcccccgcaatcgtatcgttattaatatggcccccgcagatatccgtaaggaagggtcttcttatgatctgcctttggcgatcggtattctggcggcggcagagcagatagattcatccaacttatccaaattcgtattgatgggcgagctttctatggatgggagcctccaaccgataaaaggggcattgcctatcgctattaaggctagggaagaaggctttaagggctttatcttacccaagcaaaacgcttgtgaggctgcggtggtgaacgatctggaagtgtatggagcttcgaatatcaaagaggtgctggagtttatggaggggaaacctacattgcggcctacggtcattgatacccgtaaggagttttacgaccgccagcaattgtttgattgcgatttctccgatgtccggggacaagagaacgtgaagcgtgcgatggaggtggccgcagccggcggacataatctgatcatggtaggtcctcccggaagtggcaagtccatgttggcgaaacgtctccctacgatcttgcctccctttaccttgcatgagtccttggaaacaactaaaatccattccgtagccggtaagataggaggtggcacctccttgatggtacaacgtccttttcgctctccccatcatacgatctctaatgtcgctatggtaggaggtggcactttcccgcagccgggagagatcagcttggctcacaatggtgtcctttttttggatgagttgccggaatttaacaggagtgtcttggaagtcatgcggcagccattggaagatcgagtgatcaatatctcccgtgcccgtttcacggtggaatatccagctggctttatgcttgtggcctccatgaatccttgtccctgcggctactacaaccatccggaccgtccttgtctctgttctcccggagccgtccagaaatatatgaaccgcatttccggcccattactcgatcgtatcgatatccagatagagattgtccctgtccctttcgagaagatttccgagcaacagccctcagagcctagtatcgctatccgtgagcgggtcataaaagcccgtgcgatccaggaaaggcgttttgccgcttatgagggtatttattgtaatgcccagatgaactccaagctactccatcagtacgccgttcccgacgcttccggcctctccatcctcaaaaccgccatgcaacgtctctgcctctccgcccgtgcctatgaccgtatcctgaaagtctcccgcacgatagccgacttggataattcggaacatatcgaagtccggcatttggcggaggcgatacagtataggagtttggatagggagaattgggggatgtgagattgcacttagaatacatctattaaccataatagtgcagttactaagctgaaaaaactatctttatattagttggaaattgcgctatttatggctgttgaagtgaataactgacggcttgtcgagtgaacaactgatggctatacctggtggtcagcttacggcttgggaagtgaataactaatcacttgggaagccttttgtgaatgatttaacgtgctgtatgccagtcaagaaaagatatccgagcagaaggtctttaaaagtaagctagcttacttttttagggttgtttaggaattgcggtattcttgcggactcatacctacatggcgtttaaaatactttccgaagaaggacatattagtgaaattcagtgtataggcgatatcgtggatggtaaggttcgtcgattttagttgtgcctttgcgtccatgataaccatcgaggtgataatctctatacaagtttttcccgtactttgtttgacgatcgtacttaggtgtgcttgcgtgatgccaagccgcttggcataccatgcaacggatcgttgcatggtatagttttgcattactagttgagtgaaattcttactgattagctctgctttggagagcattgacaggtcttccgtctggtctttatacatgctgctgatccccatcagcataccggtaaacaaatggttggtaatcccgcgatttattttcgtggcgtaaaactcgtatgttttgagtaataactcaaaataatctttcataagaggctgggctttctcttttagcttatacaccggattgtctttcacgatataatgcatgtctatgacagctttgctggagttcgcttggctgaggaaatcagatgagaatcccatgaaatagatctgtaggtccccgtctgccctatggatctgcaggattgatccgggcatgatggtgatgaagcttccgggttctaccttgagttgcgttaagttgatggatgcctcgatctctcctcctaggcatagcacgaaaatccccgctttcaatcggcatgggtaattcgcatacagattcagcaggcctatatcttcgatcgaaagcttcccgatcacccaatcttgaggcaggtctattttgggaatgtcattttccatgtttgtttaattattcacttatcgggaacgtttgacaaaagtaggcatttttaaagatttgccgtgtcttgtggaaggaaaattatacgagcgtctgaaacttgcggtattccggaggcttttcggagtcgcttgggtgtttgggctggactggtatggtttcttgtcgaaggaagtagttgccattagaattatcttttctgtttcgttttgattgaatttggatgtatattgtgacaggggtatttccttgacctatcaaaatagcgaaagaatcaggaagataagtggccttttatgttaaaaagtaacgttttcggtacacgttagacggcgaatatgtatgcaataggcagcattgggcaatgcctatactgccgttgggcatcgtgagtagtcgtgaataggggtgtaagtagtcgtgaataggcattcttatactgttataaccctattgtaagactgttttttccctctctcactccccataatatgaattacgatgaattatttttgctagaacaaaatgtcgttttttgatatatggctatcattcaaataattgctgattttctcttatgaatttggaagtaagtagtactttgccccgaaataatcgatactcaagaggttgagattacaaattgccattttgtcaaatccttttttcttccatcgaagcgactatcttgtaatcttgctttctctaggggcggctcttgtctgagcgcattttgtttaggcacggtttctaataaaaggaacaatgggttgtaaaaatagaacatggccactctttataaatggctctgtatgtgtaggggtgaggtatggaatctaaaaaaaggaataggtaataagacaaatagaccttgtaggatctttgtgaaatatattcttttgcatccaaattgggatcgaatggatctatacgaattgaagtaattgaaaaaagcatttatatgaggaaaaagaattttacatctatgggaatggcctgcttactgggctgttgtttgatgttgggtagctgtagctctgaagtggataatttggatattccgaagggcaaaggtttcgtgaaaatagatctggcaccggaggtcggttttcaaacaaaagccgtggatgagagtgagtataaggatgtgaacaattatactgtgcaagtgtttaaatccgggcaagaggagaatcttattattaatgatttgtataagaatttggaagagaaatattctttgaatgttggtaactatgtgttgaaagcctttacgggtgaagataaaccggtttcttccgatgtgttgtatttttctggcgaagctgcttttgaagtgaaggagggaaaggaggtgacagctcctgtaatatgtaagcccagctcagctcgaattaatgttgtgttcgatccgaagatggatgagtatttctccgactattccttgaagattgagacagaggcgcagaaaccctcttcttttgtttgggcaaaggcgacagtcggtccgatgtattttaaggtaggtaatcaggaaaaggtccaggttacggtaagcttgactaagaaagagaatgtaaaagcagaagggacggttaagacctatacgttaagtccagcggatgctttgaaacttactttgaaaccagtagtcaacaatggcaatttaggaatttcgattacaattgaggagactacggttgatcatccggtagatatcgttattccgggggattgggtataaatatatataacagtaataataagagattagaatatgaaagcgatcaatatatggatgttgagcacggttttgttttccggcttgatgtcgtgtgagatgaaagaggagattttcgggaaagagatcccaaaggaaactggctatttgacacttgacgtgagcgcaggttcctctgcttctttagcaacgaaaggagcaactgatcagaaagaagattttccgctcgtgatcaaggcgatggattttgatcttactaaaaactatgagtcgtttgctaagtttaaagaagaaaatgcgaatggtgtgattgagttgccgaaaggaaattatgagatagaggcgcattcgccgggagagtttgccgaaaagatgtacgatccttattatggaggtgtagaaaaagcagagataatgcctagtgtggaaaaaaccgctacggtgaaatgtaagatccagaatgtcaaaattgcgatggattttacctccgagtttataaactattatagcaaatggtctattacggtggatgacaagtgcggtcattcagatatttatacgcaagaaaatccaaacccaactccgatttattggaaaatggctgctgagacagataagatttatgtgtcgggaacagctatagtgaaggaaacgagtgaagaagttattataaatcagacattaacgaagaaggaaagtgctgattttgtagaaagcgacagcccctattttgtaggaggagatggtttggcgatctcgttggctcccggaaaagaagtggatctcaataaaaccggtatcaccatcacggttaacggttttaaccaagagacaaatgagaatattgatatagaagtggaaggtgatagtggcgaagagaatcctgaacctccgacaccaccggtgacgggtgatgatccgacaatcacgataccgcaagctctttatacgttgcccgctgatgaacaaaaaaatgcaaatgttattatatcaactcctgccggcttgaaaaatatcactgtcgcgataaagggaggaaatgagctttttgcgtcaatagttaaagatctatttggtgaagagtttaaattgataggaaatgaagctttaggagagacgttgacgtcaatgggtgtaactttacctgttggtggagaaaagagctatgaatttccggtacatgccttttttagtttgttgctagatccaagtactggtggaggtgttacaacagatccagaaggacacgtatttaatattacggtggaagataatgatggtaaagtcgtaaaagataaattaagtgtaaaagtggctgaataatatgaagacaatatatacacttttattttttgtgttggtattaggtttggtcgcttgccaggccgaggatgatacatccatgaaaaataccggttatttaagtatggatataacgaccaataattccacagccaccaaagcgggaagtgaggaggttgtttataatcccaaacagttggcggtacaaatcttgaatgatcaaggaggtgttgttaaggaaacggatgactatacggcgtgggatggagagcgattttccttgcctacgggtaaatacgtggtgaaagcctcttcaaatggcttcgatggtaaagctgccgagtttgataagccctattatgtgggatcagctgaggtagaggttatggcaggaaaggatgtgacggccgaagttatctgtacattggcgaatgtcttggtgactgttgaatttgacgagctgttcaagaaaagctttaagtctgcgaccattgttgtggctgattcggcagaccaaactggaacccgccttacctttgagttaggtaagaacgagacagcaaaggcctatttcccagttcccgagaagtcgttgattatctcaacgagcgtaacgaatcaaaagggtacactacattctaagaaagataccgttcgtgcggtaaaagctcgagataatgttcgcttgatgtataaagtggctgactcgccaaatggttctaccagtattgatattactttggacggaacaatcaagacctataatttcaccataggtgtgcctctgaccgctaagacaactctatcggcaagtgcggcgaacgcttggagttcatttgcttacttggaggggaaggtgctttcaaaggcaggtgtcttggatcaaagcaagttggcgatggaatataaactggcaacagacgaggcttggactccggttgcgtatctgaccgtaggtgaaaacgatacctattcggtaaggattacgggcttgactcctgcaacaaaatatcaataccgttttatctataaggatacggaagaggtggcaagcgaaatcgtagagtttactacggaggcggctatcgcattatataatgctaattttgatttatggtatcagaatggaaagacatggtatgctggggaatccggtaaatcattctgggatacgagtaacccgggtacgacaacggggttgggagccatagtgaatatcaatcctacccaaggtagttcagcggttgtgcatacatcgggcggaaaatctgcggagttgaaatcccagtttaaggtgaaattcgcagcggcgagcctgtataccggatcttttggtgggctggttggtatgaatggtgctaagatcaattttggtcagccgttcgcttctcgtccaacagcattaaagggctggttccaatacgctccggtaaatgtaactcatgtaggggataatcttccggctgacgcagttgttgaaaaaggagatcctgatgtttgttctatttatatagcgatgtctaaaaagcaatatactatagataataccaaaatggcagaaactgcgatcgattttgagaatgatgcgaacattatcgcctatggtgaggtgcctgtgtcggaatgcgtaagtaccaacggacaatggaaggagttcaatatcctcttgaaatataagaatctgacggagaaaccgacccatatcattgtggtctgctcgtccagcaagtatggcgactatttcaccggaggcgatggcagcataatgtatctcgatgatttttcactcatttacgatgacgagcctacaatgtggaaataaaccataggctgaaagtctatgtagggaacaataagtttttactataaatctatttggcaagtaaggatatcttccttgctaagtagattttaaatatctttgtggcaatataaaggatagaactagaaaatggcaataacaatagagcgaattatttgaatgagtagaaaactatttaccttattgctgttattagcaatagtgaccggtaccgtaaatgcacaacgcggtaaacgcaccatcaagcgcatcgaccgagaggtacaggaggctgtgttcatcccgaaaggaacatggatggccggaggtgccgtatcgtattccgagcatgacgagagtaacttgaactttcttgttataaaggatttggaagggaatggctataattttgcgataagtccgtacgtgggctatttcttccgggataatatctcggccggtgttcgcttcgcttaccgtaggaactatttggatctagggaatgtggatgccaatttgggcgacattaccatctcgttcaaggacctctattatctggagcataaatatgagacatccggtttcctgcgcacctatatcccgatagggaagagcaagatattcggtctcttcaacgaggctcgtgtgacctatggctacggtacgggcaagaattccacaggctcgggggttaattatgatggtacttaccagaaggtacagaacctacagattggtttcgcccccggactggctgcctttatcaccgattggagcgccgtggaggtgtcggtcggtgtgatgggtttcgatttcaagtggatcgatcagacaaccaaccaagtggagcagggttcgagccgtacatcgtccggtaatttcaagatcaatcttttttccattaacataggtatgactttctatttgtaattggatatgcgaataatcaatgatatatataaagtgacctgtcgcttttgcctttttgttttcttcgtgctggtttcctgtgcgatagagaatgatataccctatccgatcgtcaatgcgggtatcacggacattcgtgtggagggacagcgtccggctgaaggctcttcggatgatgcggcattaattgatgcttcggcaaagaccatattactgtatgtaaacgattctgctgatatttctagattgaaacttactcgtttggtggtgaatccaaggaatgcgcaggttttggttgattcgactctctgtgctaatcctaataaattcccgtttgccggattcgcctcattggatagtattcctatgtcatccaatacgagggtcgattttaccaaaccggtcaattttactataaaaacctatcaagattatgtatggcaagtaaaggtgaagcaaatcatagaccggaaggtcgaggccaagggtatgatagactattctattgacgaactggataatcgagtgattatttatgtagggaaaggagagaatctgaagaatatctctataacctctttggctttgggtggagcctatggcgaggtgacgccaaatcctactaccgtgaaagatttcacctctccacagaagtttttggttcagtatccctggagcgagcccaataaggggacaatatggacggtatatgtccgcctgaccgatgaggagggaggctcgcagccttcagccggagatctttccgtgaatacatggagcaagtatgcgtttgtggaggggaaagcaacggaggctaattgttcgtttgagtatgtgaaacagggagagacttcttggaacatggtttccgcgaaggcaaacggttcgaaggtttctgcgaagatcgagggattgcagcccgccacggcttatcaatgccgactggtggatgcctcgggaagcgtgttgggcgagtctaccttcacgacagagactgccacaccattatataatggtaatttcgatctgtggcatcaagatgggaaaacatggtatgccggtgaggcgggtcattcattttgggatacgagcaatccgggtacgacaactggattgggggctgtggtcaatatcaacccgactcaaggaaattcaacggttgtgcatacgccgggtggaaaatctgccgagttgaaatcgcagtttaaggtgaaatttgccgctgcgagcctgtataccggatcttttggcagtttggttggaatgaatggtgcgaagatcaaattcggaaggtcgttcgcttcgcgcccgttcgcattgcatggctttttccaatacgctccggttgcggtaactcatataggagataatcagcctgcggggacgctttcaaaaggagatatggatgtttgctctatctatatcgccttggctaaaaagcaatatacggtagataataccgatactgatacctttattgatttcaagggggataataatatcattgcttatggagaggttcctgtaaaggaatgtgtatctacgaatggggcatggaaggagtttaccattaatctagagtataagacgcaggaaaagcccggcgatatgcaccttatcatcgtggcaagtgccagcaagtatggcgattattttaccgggggagacggtagtgtgttatatgtagatgatttcgaacttatatacgactaaataatatgatgaagcagattgataaattttgttgttgtatattctcattatttctcatgatggcctgtcaggaggaagaaataatggataaaaccgccggctttcaggtatccttgcaggatatgggtgttgccattgagacgaaaagtacgccagcggaattgggaaagccactagcggatcagtttaagcttaaggtcgtgaagaacggggattcctctccgttgtttgatggtaattataccagccagacgatacctgcttcggccggtacttatacgatatctgcttcctatggagataatccggttttagcgttggatgcgccctattatttaggcgacactactaatgtggtgattaaggagggcgagcagaagaaaattaccttgagttgcaaggtggccaatgcgttggcttctgcctctttccccactgatacggagttgaagaaaatcttctcttcttattgggtgaaagtagttgttgggaagtcctcttgtaaattgacttctgatagtaagaaaagtgcctattttcaagcagagaaacaggttgccttttattttgagggaacaaaggtgagcggtaaggatttttccgaggagttaaaacataaggatttgccttcggtattgaaagccggacatcatgttaaactgacattgaagttatcggatgatttattgttggatgtcgctaaagttgaaattaaaaaggagacaataacgagcgatatcccgatggattggttgcctaagccgaaagttgaggcggaaggatttgagaataatatactttcctttgctgagacagagactaaaacggcaatattgaatttaaatacggcttcagcactgcaagacttgaagctgaaatttacttttggtgatccgcaattttcaagcttgaatgataaggactatcttttatctgttccggcagataaagcggaaatggaaaatgtgttaggcattgtattgcctgagattggtgtagataaagcctctttagatttgacttccattgtcgctaagttgcgaacagatgcgggtacgacagtagaaaataagattgaagtagatgtgagagcgaataatcgctggagtagtgaggagattaaagggcaagaaaacccaagccgggtttatacgttgaggtgtaataagccggaaatggcagtatctgttcaacccggaaatatctggacgaaagagtttacgattgatgaactgaccgttactacaggagatccggaggttatcaagtctaagttgaaatatcagtataaagaaaagtccggaggtgatgatacttggaaagacattcaagatatgaaagtgttattcaatgaacatccccaaaatagatcatatcaagtgagagcggtttatcgtgatgtggttatgacggatgctattgatgtggagctagagaatccggtgcagttgccgaattctgggatggaggagtggcaagtaaagctgcttggttcatttgttggtattcctgacttctggaataaatattattattacgattatttgccttataaggaaggagaaactgatattttttggactacgaataatgagcgttctagagcctattcagtatctcgtgttcatgtaacatctagcccttgtgttagttcttcggaaaatattaggcatacaggttcttattccgcattaatctatacatcgggtcatggaggagagtatgcttccacaaatggtacaatttatccagcaggggctttcgcaggtagtctatttattggaaaatatagttggaatgataagacagaatctattactccaggacatgctttttcctcacgtccatcagcgttaaaattttattataactatgtgccaaagaataccgacacattcaaggcttatgtggagttgaaaaatggagaagaatttgtcggttccggaacatttatttcttctacttcgaatgaaggctgggcagaagcaactgttactatagagtacgttgatcagccgaaggaggcaacttcaatttatgtacaatttttatcaacgacaaagacctctttttcagaaggtgattttgataaaaataagggaataacatttcctgtaatgggtagttggaatgcccatattggtagtatgctttatattgatgatctctctttaatctatgataaataatgaggagggttgtgtttatttactgtatagaataaatggaaaaatgagacactttgtttatatcttatcgattctcttctttttgccaagttgccagaaagaagactttgtcagttcttctcaaggaaagggaactttgatattggaagatctttctgttcaagtaggaaatatcaatacggtttttacccgggccgtggagaatgatctatatgtggagatttggcaaaacggtcaattaatgagcgggcaacaatatgaaccgggaaaagtgcctgctaagctggatttgcctgccggaagctatctgctgaaaacctataacctagcgtataaagacatgcccaattgggtagatacagaaactggtggagcagccttttatgctgaaaagaattttaagatagacgctggtaaaataaactatctgaatgtagaagtcccgatggtgaatatcggtgtttccttaaaactcccggaaggttttagtgatcgctttaaggattatcattttaccgtacaattcggaaaccgatccgtagaaatatccaatggagaaaccgcttatttcccctcgagtgaagtaacttacattttaagtgtcacaaataacgatggtgaaaataaaacgaattcaaagacgatcaaatcaccagtggcaggaactatatatgaaatctcttatggctatgcgactaaagggttgattgttaatgctaaatatggcttatgaaatgaataactaacggcttcccaagccgttagcttaccactgggggtagccgctagttattcacttcacaagctataaacaaggggggtgtcgttctttacatataatataaaacgtacgtgcgtacattaaaatatacagtctctctctttaaaggcaaatccaaaaacatatccagttacttttctccccttttggattaaaaagtatcttaactgtatcgttcaacgaaactaagtgtgttggccaagtatcttagtttcgttggccaatgcacctaggtgcaaatatgtattaaagcatatggacaatttccatccctcgtgtcccaaccgttattcgcaaattattccttaccttttcttgataaaagaagatttcttagcgaacaggtataagaattggagatttttatctaagtttgtcagtatacatcaaaaagaaaggaagatcttatgatacctctgataaccattccctatgccgtggctgatttcgctgaaatacgcgaacgtggcttttattatgtggataaaactcggtttatcccttatttggagcggtataaggctccggtgtttctgcgtccgcggcgttttggtaagagcttgttggtctctatgctcgcccattactacgatcgcagtaagtctcatcgctttgaggaactttttggggggacttggatcgggaccaatcctacgccggagcataaccaatacatgattatccgctacgacttctcgaagatggtgatggatagcacgatggacgggttagagcagaattttaatgatctgaattgttcccccgtggagatcatggtagagcataaccgtgatcttttcggtgattttaagttctcagtgagaggtaatgccaccaagatgctggaggaggcgttggcttatgtccgtatgcgcggcttgcccaaggtttatatccttattgatgagtacgataatttcaccaaccaattgctcacggcctataaggacccgctttacgagtctgtcaccactggcgagagcttcttgcgtaccttcttcaaggctatcaaggcgggtatcggcgagggaagtatccgtacttgcttttgtacgggtgtgctgcctgttacgatggatgacttgacgagcggctataatatcgccgaaattcttaccttgaagcctgacttcacggagatgttgggtttcaatcatgaggaggctgccgaatacctgcgctatgttattcgtaaatatggcaataatgaggatcgtttcgacgagctgtggacgcttatcgtaaacaactatgatggctatcgctttctgcccaacgcgcatccgttatttaattccactatattgacttattttttcaagaacttcgccgagctgtccggtggtgtccccgatgagatggtggacgagaaccttcgaacggacgtgaattggatccgccgccttaccatcaccttggagaatgcgaaagagatgctggatgccttggtgatcgatggcgagttgatctactctcaaccggatcttaggagtaagttcaataagcagaagttcttcgatccggatttttaccccgtcagtctatattacttgggcatgacaacgttgaaagataattatgtgatggtgcttcccaacttgaccgctcagagcatctacatgaattattacaacgagttgaatcagattagcgatgacgctcgctgttttgttcccgcttatcgcctgtttatggatcatcggaagctggagccgcttgtggaaaattatttcaaggaatatctcggccagttcccggcgcaagtattcgacaagatcaacgagaactttattcgttgctctttctacgaggtactgagtcgttacttgagcaactgctataccttcgccgtggagcagaacttgccaagcggccgtgcggatctggtattgacgggcatatcgggcaccgccttccacaacgattgccgggtggtggagttcaagtatttcaaggcgaaagacgctaccatggtagaggccttgaaggtcgttcgtcccgaagatgccgatcaggtgagaagatatgccgctgatatcaatcggcaattccccgcttaccgcatgcgagcgtatgtggtgtatatagcggcaggaaaagtttgtaagacatgggaagttattaatctctaatgtaaaggacaagacatgagacatttgttgattattctattatgtcttgatcggcaatatatactatgcgatcgaaagaggaatatatccatccttgaatgatattccaatcttttttatctaaccaaattattccgtacctttgcccctcaaaaagagaacacaaggtatggaaaaacattttaagagaacgctgattactacggcgttgccgtatgcgaacggaccggtgcatatcggccatttggccggggtatatgtgcctgctgatatttatgcccgttaccttcgtttgaagggagaggaagtgttgatgattggaggttcggacgagcatggggtacccatcacattgagagcgaagaaagaggggattacaccgcaggatgtggtggatcgttaccacggtattatcaagaaatcgttcgaggagttcggtatcacgtttgatatctattctcgtactacttccgctatgcatcatcagatggcctcggattttttccgtacattgtatgataaaggtgaattcatcgagaaaacaagcgagcaatactacgatgaggaggcgaagcaattcttggccgaccgttatatcacgggtacttgtccgcattgtggaaacgagaaggcgtatggtgaccagtgcgaggcttgcggtacgtctcttagcccgacggatttgatcgatccgaaatccgctatcagtggcagcaagccggtgatgcgtgagacgaagcattggtatctgcctttagacaagtgggagccgttcttgcgtgaatggatattagagggacataaggaatggaagccgaacgtatacggacagtgtaagagctggctggatatgggactgcaaccccgtgcggtgagtcgtgatttggattggggtatccctgttcccgtggaaggggcggaaggaaaggtgctgtatgtctggttcgacgctccgattggttatatctctaatacgaaggagttgttgccggatagctgggagacttggtggaaggatccggagactaaaatggtccatttcatcggtaaagataatatcgtgttccattgtatcgtgttcccttccatgctgaaagcggaaggttcttataacttgccggagaatgtccccgctaatgagttcttgaacttggagggggacaagatctctacttcccgcaactgggcggtttggttgaacgagtatctggtggatatgccgggcaagcaagacgtgttgcgctatgtcttgacggccaatgcgccggagacaaaggataatgatttcacatggaaagattttcaggctcgtaataataatgagttggtcgctatcttagggaacttcgtgaaccgtgcgttagtccttacggataagtatttcgagggtaaggtgccggcggctggcgagttgacagattatgatcgccagaccttgaaggatttcgcggatgtgaaagagaacgtggaacgcctgttggatacctaccacttccgtgacgctcagaaagaggcgatgaacctggcccgtatcggaaataagtatctcgctgatatggagccttggaagttggcgaagacggatatgcctcgtgtcgctacgatcatgaacatcgctttgcagattacggctaatctggcgatcgcttttgagccgttcttgccgtttagcatggagaaactgaacaagatgctgaatgtagagccgttgggatggaatcgcctaggtgctacggatctattggaggccggtcatcaattgggcaaggccgagttgttgttcgagaagatagaggatagcgtgatcgaggcccaagtgcagaaattattggatacgaagaaagcgaatgaggaagcgaattataaggcgaaaccgatccgtgagaatattgagttcgatgattttatgaaactggatatccgtgtgggtacggttctagaatgcacgaaggttccgaaagcggataagctgcttcagttccgtatcgacgatggcctggagaaacgcacgatcgtatcgggcatcgctcagcattataaacccgaggaattggtaggcaagcaagtttgcttcatcgctaacttagctcctcgtaagctgaaaggtattgtttccgagggtatgattctctccgccgagaatttcgatggaaagctggccgttatcactccggagaaagaggtgaaaccgggtagcgaggtgaaataataaggtagacgcaataatgagggggctattccgttttaacgatgggatagccctatttttgagtggataagatgcttgagaaacagatacagatggtagatctgcggaagcagtatgaacgtttgcgtagtgagatcgatcccgccatgcaaacggtgataaatgcttgcgcctttatcaatggccctcaggtgaagggattttgtaaccatttatcagattatttaggtattccttatgcgatcccgtgcggcaacggtacggatgccttgcaaatctccttgatggcattagacttacatccgggcgatgaggtgatcgttcctgcttttacgtatatcgccgcggctgaggtcgctttggctcttggcctagtgccggtattagtggatgtagatcccggtacattcaatatagacccggaaaagatagaagatgccttgtctgaaaagacgagagctattatcgcagttcatctttttggccagtgttgtgatatggaaccgatcttgcgtattgccagccgtcataatctatatgtgatcgaggataatgcccagtccatcggtgctaattatactttctcggatggaacggtgaagaaagcctgtacgatcgcctctataggaacgacctccttcttcccttcgaaaccgttggcttgttatggtgatggtggggcgatgtttacttccgacgcacgattggccgaacgactgcgaatgatcgccaatcatgggcaaaaggtaaaatatcatcatgctttggtgggctgcaactcccgtttggataccttgcaggccgctgtcttagatgttaagcttcggtatttggatgaatttgccgccgctcgttgtaaagtggctgctagatacgatgctgccttttccggattggatgctgtacgcaaaccactaaaatcagccttttcatcgcatgtttatcatcaatatacggtacagctagctgtagaaaagagggatcaagtacaagctgcgttaaaagaacgaggcattccttctatgatttattatccattgcctttgcaggagcaagaggtgatgagggggcgatgccggatttccggggatttgaatgtcgcttctcgcttgagccgatccgtattatccttgccgattcatacggagatgacagaagaggagcaggcttatattatagaatctataaagagtgttttatgaataagaagatacgtttcgccgtgatcggctgtggtcatataggtaagcgtcatgccgagatgattacccgggatgaaggagcggagttggtcgctttatgtgatatccgtccgaaagaggagctggggatcgaggcttatgcggtccctttcgcccgggatatagatgaactattccgtttgggattggatatagatgtggtgaatatttgtacacctaacggcttacatgccgagatggcgatccaagcgatagagagtggacatcatgtggtcatagaaaagcctatggccttgaccttggcggatgccgagaaagtggtttatacctcgttgagattccgtaagcaggtattttgcgtaatgcaaaaccgatattccccgccttcggtctggatcaaggagatggttgagtccggaaaattaggccagatttatatggtgcagctgaattgctactggaaccgtgacgaacgctactataaacccggaggatggcatggcgacgctgccttggatggaggtaccttattcactcaattctcccatttcatcgatattatgtattggttattcggggatatttgcaatatccagtcccgtttcgctgatttcaaccatgagaagctaacggcgttcgaggattccggtttcgtcaatttcaatttcgtgaacggaggaatgggaagcttgagttattcaacggcggtgtggaataagaatatggagagcagtatgttgatcgtggcggaaaatggaagcgtgaagatcggtggacaatacatgaatgaggtggaatattgccatatcaaggattatgagatgccggaattggctcctaccaaccccggcaatgattatggcccttacaaaggctccgcccagaaccacaacttcgtgatccgtaacgtagtcaacgtcctttccggcgctccgggcgagatcataacgaccaacgtgttggaaggcatgaaggtggtggatatcattcagaggatttatgcttcttcttgaaaggatatgcaagccccgtaatatccgacattctgcaagacttcgtgaaaactttttaatacagagctgcttattaaattggactcttgatcaagcaatgtttgtggtgctttcatcgtgagaacgatgatctctgcattttttaactcctcttttagctgttgtgtacttggatcaatgatatcgctattagagtatactaattgccgtttatgagtcgcctctggtataatcagataactgatcaggtctggggctgtgactaaaggacttccttgcccggaatcccaaacgatcaagctttcgttttgaaaaataatcttgataagattttctggggtttgatcttgttggatggtcatcaacccgctatcaaaacctccgatagcggtgttttttgcgtctaggatttttccctgacatacgatttgagagtggtaattaatagtgttaagtacattttggatagaggagatattcggctttattaaatattgttcgtttcctatgatttttcccaattgtatacattttgttattgtccctttgatcagaatggctttgctcattaaggcccggtccatcgtccacatcgttatgccaccaacttggtcgaattcacgcatgcttagggctgatcgtgccagagcctcgatcgtggtagaggcagaagcttcacgactatcgcttacttcatatacgattttatagtcagagctgttggtaagtacgcaaggatttacatcggctccatgcgtcgcgaaagttgtcatctgcaataagggaacggctctgcctgcgccatcagcgttaatgacggtaagattcaatttagccccgacaaggcaagaaacaagagtcgagattcctcctacctcaattggcacgatataaccgagttctttccctcttttcttgagttcttcttggattgtattgaccgactggatagccgcatctggtgtaacggcatcttttagtttcgtaggggtacctaaataagctaaaacaatagcgcatttagagtcgttttccggaatatcatctacatcgatgatggaaacctcagtacgttcgtaatgcttctttgtgaaattttggacaaatagcatcgcgctatcatacgttccaccaccgccactagctaggaatgtagctcccttgactagattctcgaggtcgatttgcttaagaggttcatttttctttttcatggtttgtcgtattatattgatttcaataagtgcttaacatgctcggctcctgtttcatccgctatatccaatgctttttttatagcgacttccatattttccgtatcgccaagagctttatggcactttgcctttaggaagtaaagctccccgaggtaacatttttccttattagcttctatgataggaaatgacatgtttattatatctaaacaagatctataatcattataattcaagtggaccattcctaataaataagtatagaaaggatgagtgatatcagttgtcgaggtcttatcaggtatgaggcttttatatccttcttcgagaatacttaacccggtttctttctcttttaaggcataagtgaacccgtaaaacaatttgctgaccgcagtgtagtaagaaaaagaatgatcttcagaggttttgtggactttgagggcaaattcctcacagcgttcgtaattcccttgcaaaagctcgttccatgccacgacatgataaaagatagctaggacaaaataatcctttaccgaggtgtaccgatcttccatatcctggcttaatttcttgaacacctcatattctcccgcttcaaaagccgtaatagaggcgaacataaagtagaatagattattgatagaagtagcttgcctcacgttttctcccatttggtcaatcaacacctcatactcatgaagaaataattttagcctcttgaaatctccgatccagaagagggtattgataagcataatataaccggtctgcagaccgatcaaattctcggattcctttgtctgggcgatatttttctcacatagatctacgcacttgtccagatctatttgcatgaagtagtaaatccaaatgcaatacgtgatggtatccatgtaatcgaaacactggattttcttacttagctggtttgcttccgtgaatagatccatcgggatcttactcccccagccaatcgtattgcgatagcataatcccagttttacggtggcttccagacggatccggtcgtgctccatatcatcggcaagatcatccagatacttcaacatattcttcaacagaggaatagcgttctcaaacgccgatattttcatcatggcgttcacggagatcatgataaacctcaatgcgctgtcgtattcaccggacatctcatagtgatacgctatatctccagccatttcttctatcttgtctttgaagagttcttgtaatatagttgctatatccgaatgcaagaccatgcgttgggttaagctaagttcttgataaatgtattgttggaatatataattagagaaatagaatttagatacaaactgttttccggaccgtacgcaatctccttccataacgagatgatgctgtttctgtaattttttggaaaggctcatcagcaaattccgttccgattcatttagggttctagataatacttgaagtatgaaattcggaccttgaacgcttgcgtgtgaaaggatttccatcagcgagtcctctaagttgctgatccgttcttcaatgataccctcaatccggatcggataatcatgccactccatgttcttttggtttttccagatctcatcttcttgataaacaaccccctcgtctttgaacaagttcatcatttccgtgataaacaatggattaccattcgtccgctcaaatagtttttttcggaaagatgctgtatactggttcttatccctgtcaagaatttgattcatgaaatcttttctgtcggcctctgacagattatctaattggatgaaaacatttccgaaagctatctttatttcattgataagcttttgcataggatgccgcccttcgccagtatagccatcgatatcttcactgcggtaacagccgacaatcatgagggaagaacgtcgtaaggatacgattagctgataaagtaattcgacggacggtttatcgatccactgtaggtcatcaataaataggacaatggtatatttctcactaatggcacgcatataattaacgaattgctcgatgattttcgattcgtctatagatacgtcttcccctgtcttttgcgcttttagccgttcaagaatatttgtcttctcaatgattgattggctaattccacttaggatactacctcccggaattaaactacctatcaagtccggcgcatgggtcaataacatggaggtagagaaactaagtaattcctttaggttttccttactccatctcttattggccgagtcttcttgaatatcctctatcagttgcttaagtatttctttaaaaggttgatacggaatattgtattcggaaggtatgctgcagaacgaagaggcaatcactattctttctgtctcttttatgtcgtttaagaaagtttgtatgagaactgatttaccagtccctgcttctcctgttataaactggacttgtaattctttttggctagaaaccttttttaatgaattttccagcaaagcgatctctttgtttcttcttataaaagataattgttcttccataatactatactcaacgattagtaatgaaacaaagatgtgaaaaatattcaataaaagaaagtggtttactgaaaagatgttttattttcatttttgtaccgtgaggatttatgcagggagggcataaatcctctggatacttaggttttagatctcgtcggggctctcgctatctcctccacttgggttctccgcttcgggaagtttcgctttttcgaaaacggcgagttttttggatacccgcaaagcctttcccgggctgaagaccactttcggttctttaatcaggttattggagaactcctcggtggtagcggctcccgtagagcctaccccaaaacggaaattacccaattcgcctacattcaccctgcgcccttgcgagagatttcgtttcaacacgatattgatacggtcgagtaccgccttgacttgggcggagcctactccacttccatctgccacttcctcgaggaaagtctcgaactctacaagatctccatagaccacttgcgcatactgtttcttgggtgtttctgtcttgtcgttacccaagttctttctctcgatcaatctgtactttactgccataattcctgaattttaaaagatgattaaatgaattaccttgttttcgaaaacatgacaaaggtatcgcaagccgtatgaggcaaatcggtctgtgtcggtttatgtctgtcaatgtccgtgtatgtgcctattagtctacgagtgcctgtttcgcttcctttagttcacaagactagtaaaatgtaaaaatgtacaataagctatattagaatgggtgtgttttgtatatttctgattattagtttattatatctgataggtgcgagactttttaattagtatcaatagaaatccggatttctattgatactaattggtgttttctattgatactaattcatatttccatacgtactatttgttattttatacataaagtatgaaaagcttccgggttttgcccgttacccaagagtaaatgtttatctttgtggcacttttaccgtaaatatcaaatggcagaacaatcactaaaagataagacagcgaaagggctcttctggggaggggtgagcaatggggtgcagcagttgttggggatgttgtttggtatttatctggctcggattcttaatgcggaggattatgggttggtagggatgttggcgatatttagtggaattgctggtacgattatcaatagtggatttacggtagcgctaacaaataatcaaaatgcgactcataaggattataatgcggtgttttggtttaccttttttatcggtttgattttatatttagtgctgtttctggctgcgccgttgatttctgagttctatcaccgaccggaactaacagctttatcccgtgttttgttcattagctttttcgtctctgggattgcttccgttccttatacggtcatgtttaaaaggctgatgattaaggaacaggccaaaattgatattctgtctttgttcttctcggggattataggggttagtctcgccttaaatggcttcgcttattgggcgatcgctttgcagagtatgtcatacgtgacgattaattctttgctgaagtgctatgtctcgccgtggcgtcctacatttgaatttgatttttccccattgaggcatatgttctcttttagcgtgaagctcttcttgaccaatgtgtttacccaaattaatacgaatatattttctgtattattagggcggttctatgatgctcggcaagtaggattttattctcaaggtaataaatggcagggtatgggcaatacgtttatttcagggatgatcaatagtgtcgctcaaccggttcttgtctcggtgggggatgacttgtgccggcaaaggaatgtgtttaggaaaatggtccgttttggctcctttgtatcctttcctgtgatgcttggtcttgcttttgtcgggaaagaatttatctgtgtgcttatcggggataaatggctacccagcgtacccttcctacaacttttttgcatatggggagcggtgagtttcttatggaatctatattcaaacctgttgatctctcatgggaagtctgatttgtatatgtggggtattgtttttgttgggatgatacaacttctctgtgtgtttgcttttctgcgttatggtatatattatatgttaggggcttacatcagcgtttacttcttgggaatcctattttggcattattttgcctcacggcttatctgtttgggcctaatatatgtgataaaggatatgttaccttatttgttcgctacattcttgtcattttttatcgtatgggtgttgacctatcagatagaagatatgttgctattgctaatcttgaagatcgttttgtcagtactctcttatgtggtaattatgtggctaggtaattcagtgatatttaaagaggcattgacctatttaagaaaaaagtgaaacatgaagcaatatataaatcatttgtactttaagattaaggtcgcattcttttattggggtgtgtggttgattaatcagctaatacggcctaattgccttgatgtgaaaaatattccgatcattattaataataggaatcgattaacttatatgaaaatgttgatatcctctttagagaaaagaggatacaataatatatatattattgataatgattctacctatcctccactattggattattatagtaaagaatgcatttatcctgttttttatttgaataaaaatgtgggttataatgctttatgggattccggtttgatccgtaagttcaggaaaaactatttcgtttatacagattcagatgttgtcttatcggatgaatgcccagctgatatcttggaaaaggcttattctatattaggacgatattcgaaagtacataaagtagggccagccttagaggtgaaagatattccggaagaaaattggaaagcagtgtggaatactcaatcggatagttggcaaaaagtgatacatggtgatgattttttactttatgaggccatgattgatacgacatttgccttatatagaccttttgtaacgaagcacctaggtgttttccgtaatcaaattcggatggggtatccttatgtcgctaaacatatgccttggtatgagagagaaaatcatatgccggaagattcattatactatcaacaaacagcaaatattgaatctacttggtataagaggagctaaataatgatcaattcatgtagttatgaaaaagatagtattgatatttaatcattttgagagagagcattttggaaaagatgtctttctatttccttatactttgtctaaatgtgtgggagggaaagccatgattgtatatcctgagacatcttcaaataaaaattttccaagtgaatatagaaatgtaaccctaaaatcgcttccttttaaggggaaagaatctagctggttcttatatcgggaatggaattttttaattttcttaattagaaaatccaaagagattgatatccttttacggatacattttacgtttatgacagctttatttgtgctgttatataaaatgataaatccaaaaggtattactgccgtcaagttagatggctatctagatccattattctttagttctgattctctttcgttatttaagagattgaaacataaagtattttttagaactttaaggcaagtggatttattaacggtagagactcaatgcttatatgataggttatataaggaatttatagatgtttatgatataaaactgaaattggtgttaatgccaaatggctttgatgaagaaacattgaaaactctgtccattgtagagaaggattttggacataataatgattacggtaggtagattgggaacatatcagaaaaatacggaaatgcttttaaacgcattggacttaatggaacttagggattggaaagtgtatttgataggtagcatttcagaggatttggacttttttttgaaggatttttttatgagaaacccgtcaaaaaaggaatcagtcttttttgtgggtccaatttatgataaaaagagtttatgggagttctataatagggcgaaggtttttatattaacatcgagatttgaaggctatcctttagttctaacagaggctaagagatttagaaattatattgtttcaacagaattggatgcttcggaagatttattagagaatgggaaatatggttgtttgatagcccaagagaattataaggaactcgctttattttgtcaaaaaatcatcaatggagaaatttgtattgatgtgtatgaaaattatgataaagaagatatctcttgggatatgattatgagaaaacaagaaaaagtgatgaacaaatttttgtaataaggatggtggatgtttctgttatatatgtcaattatagaactatacaattgatattggatagtgtcaaatccattaaagaaagaaccttaggcataagttatgagattattgttgtcgataatgcttgtgatgaggaatcatttcgtttgataaaagaccgttatccggaaataatatgtattcagtcagttgataatctgggatttggtaaaggaaataacttggggattgagcaggctcaaggtgattttgtgttatttctgaatccagatacagttttacggaataatgcgatagatatactttgtcgtttcatgaaggataatccgtctgtagggggctgtggaggtaacctatatgatgaagagggaaacgctactacttcttttagccgtaaatacccgtcttttttatgggaactattagggatcttatatataccttcactttgtatttcgtcgaggcgttctttattctttaattatgaaggaaagccgataaaggttgcttctgtgataggtgcggatttgatggtaaggagaacggtgctatcctctgtaggaggttttgatgcggatttcttcatgaattatgaggagacagaattatgtcttcggattcatcggtcgggttgggatatatattcagtgccttcggctcaaatcacacatttggaggggcgtgcctcttatataaaacaatctcgtctttatttcttgtatgagggacaatatatttatttccggaaggtttatggtaaatttgggtgtcgattgatttttgccattacgcaactgaagagttatgttcggatttttcagtttcttttgttgggaaatcggaaaagaggggcttactggaaaatgaaactagagacgaacagggaggtctggaactccgaaagaataaaacgtattttgaaatgaaaaagaagctagtggtttttcatccggcgatagctccttatcgagtagatttttttaattccttgaataaggagtttgatgctatattctattttgagtttggagatgtattggagcaatctttcgctcaagataagttgagaggacgattgaagttcgtaccccattttttggctccgggattatttggaattaagaatctaaggacgcaggttttctcgatattgaggaaggaacagccgaatgtggtattttgtagtgagtataatatattgggtttattattgttggtttataaatttctattcaactggaaattgtctatttttacgatctgtgatgatagcaaagagattgctgaaagcgcaactcttgtgaaaagatgtatgcgttttattgtggttaagttttacagtggtattatcttgacaaacgacgatgtgttgtcttggtatgttaaacactttcaggcgaagcagaaatttttgtttttcccgattatccaaaaagatcaagattttaggttgctattggagaatgcgttgcctgtttctaagatgttggaggatacgtatcatttgagaggaaggcaagttctgctgtttgttgggcgtttaatagatatcaagaatttattctttttactggatgccttggccttggtcgtagataggtatcctaaagctgttcttttatttgtgggtgatggtgatcagcgagtcgctttagagcgacatgcggagagaaatggattggctgaccatgtgattttcgcagggaaaaagcaaggtaaggatctatatgcttattataatgtcggtcagatatttgtgctgccaagttattatgagcgttttggagcggtggtgaatgaggcattattggctggttgttataccttatgctctgttgttgcgggtgcggcttgtttgattgagccgcaaaaaaatggtgatctctttgatccggcatctaaaaaggatcttgcggagaaattggcgcaaggtctagagtgttgtaaggatctgagacatatatcgttaaaagcaaataatatgtgttatagttacgatctgtatataacctctttttttaatcagttaaattctataatagataagtaagaatggatattcgtttatattgggagaaagtttattgggcgttggcgaaacgtgtttttaaaagaaagcagaaaacttatgaggattggttggcgaaaggatataccaatcaaccacttgttagctttattatagaatctcataataaaagtgtgggagtcaaacgtattgtcagcgaattacgtgagtatccgaacgctgagatcgtagtaatagatgatggttctgagtacaaacatactaagtctcttatgaggtatcttactcgtggtaatgaatttttagtacgagctaatgatttatatgagaatgtgatgtatgataaaaccattcgttttgcgaatggcgaatatattgttttaatgcaggatgatgatgagataaccgatctggattgggttgataagggtgtctcttattttaagaaatatccggatatggttattctcggtggtttgaatggattggaatttgttaccgatgataaggaaaagtggggatatgtggatttgtataaggatgatagactacgagataaagatttttattttgtgcatgcagtaaaccgggcccctatgttgttaaacaagagattgttcctagatcatttgggacatattgatttctcttttgctccctttcaatgcgatgattgcgagctgtgtctacgtgcgtggttgtgtggcttgaaagtagggtggtataacgccggctttaagtccatgatcgctggtggaatgcgtatttggaataaggggttgatgggatttcaagaaatcaagaatcgagggaaattgtatgagatgtataaattttcttcaagtaaagtctctgagttagtagaggtcgcaaataaacaactaaagtcataaaaagatatgtccattgatgaatataggagaataaataaatcttttaagagagttctgatatttaagatagggctcaactctggttttttttctgaatataataatatgattctggcaatgttgtattgcttagaaaaccggattcaattcaaactatcatcaaatggtgcgaattttaacacccagtttggttggaatggctattttgatagtttttgtgattctgtagtagataatagattacactatagaacgttagattggagatattctttgaaattagttgttaaacgttttgatcgattagctgtacattctcttttttcatatatgagtttttggaaaaaagagttattaacgcaagatgtttttggcaaatgccgggataaattgaggtatcgaaaaagacacgttattccggagctgggatttcgaggaagtacgcaggagatatgctctatgcttgtctgtttaacttggaaatataatgattctacgaataaaagaataaaagaaattctaaagactctttccctccctgataaatatgtatctatccatgtgaggagaggtgataaaattgtagaaagtccttattattccttagaacgatattttgagaagttaggtacgaaaaataagaatttatttgtagccacagatgattatactgttattgaagatataaaaaagaaatatcctgattggaatgtttggacattatgttctcctttggaaagaggatatgttcagtctgttgcggataaagagagttttcaggagaaagatcggaatatgattttgttgtttgccacaatggagatcttgaaccgatcagagcgatttgtaggaacctataattctaatataggaatgtttcaaggtatgagaaatccgtcgatttgtagtggtgtggattttgatcattgggtagtttggtaaatggagactggagtatgagagaaaaccaacataccgaatttaaggagtcatggcatgacgaatatacccgttatatatcagctttctgtaatacggagggtggtgtattatatatcggtatcgatgataaaggagaagttgtagggatagagcagccaaagaagttgattgagaaacttccgaactttatcgctcagaaaacgggtattatgcctcttatccatttgagggagaaggctggtaaagaatatttggaaatagaagtccaaccttctgccatgccgatttccgtgcatggacggtattatacccggagtggaagcgttacttccgagttacaggggaatcagttaaatatgttcttggctgcgaaaatggggttgacatgggaaagtgtgatcgaggaggatttctcattggaggacatagataccgagactgtagaacgttttaagctattggctaaagatcgggttccttccattgagcaggaaacggatctgctggctttaatggagaggttgaatttggtcgtaggaggccgtttcaagagagccgctgtggtcctgtttggaaagaacgtgcagagatatgtgttacaagctcgtattaaaataggaaagttccttaccgatacggaggtactgacaaccgatattatcgaggggaacctgattcagcaggtggatcgggctttggatatattgcgaacgaaatatttattaagttatatatcgtatgaggggattcataggcgtgagaaactggtttatccctacgaggctctgcgggaagccttattgaattcgattatccatcgagaatattttgtttcttccgaaattcaaattcgtgtttacgaaaataaactggtgataggaaatgaagctcgtttacaagatatcacggtagaggatttatctcgatctcacccctctaggcctcataataaattgatagcggatgtcttttacaaggcaggttttattgaaagttgggggcggggaacacaacgtattattgataactgcgtagctgagggattatccgctcctatgtatgagtataagatgggatttttgtacttaactttttctcatgagcgggtaaatgagcgggtaaatgagcgggtaaatgagcgggtaaatgagcttactgatacagagagagctgtctataggctcgttgcaaataagccatctgttactcaattagaattagctgcggagttgcggctaacggtacaatatattcgcaaaataatgaaggcgttgaaagataagaattacatagaacgtgtaggtgcagataaaaatggttattggaaaataatagagaagtcatgaagatattgatattaaatacctctgaattaactggtggagcggcagtcgccgcgaaccgactagcgaaagcattgggtaaatctggtgtagaggtttctatgttagtacgtgatcggaaaacagaccatgtaaaagttttctctgtaaataattcatggacttcacataggcttaattcttttcgtttcatttgggaacgactgataatctttatctgtaacttctttagcaagaagaacctctttcaagtttccatagccaatacaggcacggacttatcgaagcacccattagtgcaacaggcggatgtgattcatctgcattgggttaatcaaggatttctatctctttctgatattaagaaattagtaaataccggaaaacccattgtgtggactatgcatgatttgtggcctgctacggctatttgtcattatccgggaggatgtgagaagtatatatcgaattgttatcagtgcccgatgctgaaacgaaatccgttttttgatttagcggcttctgtttttaaggagaaagggaaaatagggttatctaagattacatttgtcggttgtagccgatggataatggaagaggccaaaaaaggcaattggttgagaacagcctgttttacctcgattcctaacccgattgacgtgacagcctttaagcgtatggaaaagcgggtggcccgtaaacgattcggcctgccggaagataagttccttcttctttttgccgccgctaagctttcagatacccggaagggagcgatttttttgatcgaggcttgcgaaaaactaaaagagaaataccaagatcgcatagaaatcgtgttgatgggaaatagctcggaagaattgattagccagtttccttttaaggtgaatacgctgggatatatatcggatcaagactctatgatttccgtttatgcctgtgccgatatgttcgttattccttcgttggaggataacttacccaatacgattatggagtcgatggcatgcggtacgccttgtgtgggatttgagacaggagggattccagagatgatagatcatttgaagaatgggtatgtagctaaatataaggatactgaagatttagcggagggaattaagtggataatagatagccgggaatctttacaattaagtgaggcttgcattcgaaaggtccatgattgttatcaagaatcggttgtagcggggaggtatattgatttgtatcggagtttaacttcgccttagaatgaattctttggatatttcatctatatcaagaatatagttacttttgtgaaaaatggaagttactatatagtataggaaggaatgctatgagatgaaagagtatttatcaaatgttttagagatattggaagaaaaaggcgttttgaacgaatcgtatgatctggagttcaaaagtgcgaagggggggcttcctcggtctctttgggagtcttattctgcgtttgctaattccgagggaggtacaattattcttggcgtttccgaaaaagataattattgttatttggatggtttaggagaggatgttgtgcgtaagtggcttgatgatttttggaatcagataaacaataaagaaaaagtgagcgttaaccttttgacggctaaggatgttcgtatagaaaaggtgaaagatgatattaatgtattaatcataagggtgcctcccgcaagttttcgttatcgtccggtttatataggaacggatatgttaaaaggaacttataggcgagatcatactggagactataggtgcatgccagaggaagtaaagcgaatgttggcagattccttgcctgataaacccgattctcttgtgttggaacattcgacgatagaggacttggatttgccaacattagatcaatatcgaaatattcttcgaagtgttaaacccatgcatccctttttgacacttgataatcttccttttttgcagaggttgggagcttggaaagtaaatcgagcgacaggaacttatggtttaactgccgcaggattattgatgttcggaaaaacacaatcaatacaagaatttttcccggactatcatgtcgattaccaagagatatccaatcaagggagtcgctggatagaccgtatatatccagatggtacatgggaggctaatctttttcaattttttcatagggtatggcctaaattaagtttttctttgcccaaaccatttttattggagaatgggaggagacgtgatgaaggtgctatccatgaagctttgcgtgaggcttttgcaaacagtattattcatgcggattatagggggcagggaggaattgttataaagaaatatccggatcgattcctgttcgtgaatccgggttatatgttagttcctttggaacagtattataaaggaggatgtagtgtcccgaggaatactacgatacaaaccatgttctctttattaggttatggtgaaaaagcagggtcgggtagtcttcggataatgtcggcttgggctagtgcgcattggagaaaaccgtttatatctatgaccaatagaccggatcgtgtttgtctagatttaaaaatggaagtattgttgcctaaggatagtttggagcacttagaatatatatttgggaaggatgttcgtaatatgtatggggatgctttggttatattgtctaccgctgagatagaaggggttgtctcaaatcttcgattacagggtttacttaataaacattcctcggagatatctattatgttaaaagatttatgttcgcaaggatatttaaatccagagaataagggacgttggacttcttatcatttgaataagggaataggacttaaacaaggaagtttatttgagaacttggatggacaccttaatgaaaagatggacacctcggacaagaaagatggacaccttaatgaaaagatggacacctcggacaagaaagatggacaccttggcagaaatatgcaagaaattaaaagctcagaattaaagtcttatattgtagaaatttgctcaagtaggtatttaacaatcgaggagattgcggtaaaaacccgacgtacttcaaaatatctgaagaataagatagtatctcaattattgaaagatgggcttttagaacgtttatatcctactactccaaatcatcctaatcaagcatataaaaagaaacaacaatgaatcagcaacctacattttcgatcataacgatcacctataatgcggagcgatggttggagcgtacgatattgagcgtacttagccagtcgtatccgaatatcgagtatatattgattgacggagcgtcgaaggataagaccgtagagatcatcaagcaatatgagtccggtatcgcttcttggataagcgagcctgataaaggcttgtatgatgctatgaataagggattgaagcgggctacgggggattatgtgtggttcctgaatgcgggggatacactttataccgcagataccgtgcaaagaattgtggcgtctttgaaaaagaaagtatctttgccagacgtgatttacggagaaacccggatcgttgacgcggagggtagatcattagggatgcgcagattgaaagcaccggagaaactgacttggaagagtttccggatgggaatgttggtttgtcaccagtcgtttatatcaaaacgggagatcgctccgttatataatacggaataccgtttgacggcggattatgattggtgtatccaatgtctgagacgatcgaaaagaatacataatacacgtttgatcctgtctaattttttggaggaagggttaagtagtgtgaaccggaaagcttccttaaaggagcgatatgaggtcatgtgtaagtattatggcaaggtgtcgacgattctgttgcatggttggttcgccgtgagattctattttgccaaatggtttaaaggtagagtataaacaataaattatagataagttttatgcggagtataatgagtaaatggggaaaacatatcgcagcgatagccgtattcttggtattgacggtgatttatttttctccggccgtatttgagggtaaagtcgtccggcaaggggatacggaaaaggctatcggtatggggaatagccagatggatgaatatgagaagacggcccaaccgggagaattcagcgcatggtctgatgctatgtttggcggaatgccttatgtgtcgggatatggaaatccggctccacgatttcccggatatcttttagtggagaagcctttaaaagcgctggggtatatggatgcggggatggtgtttaccggattcgtttgtttctatatcttgatgtgtgtcatgggcgtaaattggtggttggcgatcgctggtgctatcgctttcgctttagcgtcttataatctgatcattatagaggccggccatgtcacgaaagcgtatgtaatcgcttatatgccattaacgttggcgggtatggccctgttgttcaagcgtaagtatttatggggggcggtcgtgttcttgttgggtgtcgctttctctatcgcgaatacgcacctgcaaatcacttattatttattattactttgcttcttcgtttatttgggatatttgttcaataaactgaaggaaaaagcttataaagaactgggtacggtaaccgctattatggctggatgcgtgatattggcggtgttgccgaatgcccagaatatgtatgctcaatgggatttgggacagaactctatccgtggggctacggaattaacgacaacgaccccttcgggcgagaagatctcttccggcttggacaaggattatgcgttcgcttggagctatggaaaaggggagttgttgaccttgttggttccgaatgcctatggtggaagttcgggtggaatgctaggcccggattctgagttatataaggaattaagggcgaaaggcgctcaagtcggaaaagaggtacaggctcctacctattggggagagaagacatttacttccgggccggtttatttcggggcattggtctgcttcttgtttgttctgggaatgttcgtgatccggaatccgatgaaatggtggttattcggaggttctgtctttttgatattgctggcattgggacgtaattttgataacttcaatgactttatgttccattacttgccgatgtataataagttccgtaccgtagagatggcattggttattccgggtatggtatttcctattatcgctatatggggattgaaagaggtgttatccgagaccgtgagcgatgccttgttgaagagaggattgatcgctgctttggctatcacgggggggctttctttaatcctttggttgatgccgagtatgctgttggatttccgttcttctttcgacgctcaatatcagttgccggattggtattacaacgccttgttaatggatcgtgcttccttggcttcggcggatgcgttgcgctctttggtctttatcttattaggggcggctttgttgttctggttctatacctcgaaagatcggaaaaaggtggcgacattcgtagggatcggtgttgcggtcttgatgttggttgacttatggacggtggataaacggtatttgaacgatagtaactttatccgccagaaacctacagaggtatataaagagacggtagccgatcaagaaatcatgaaggataaggacctttcttatcgtgtcttgaatttgaataatcctttcttggagacaacgacctcgtactatcaccattccgtcggtggttattacgctgcgaagctgagacggtaccaagaactgatcgaccaccgtctgcaaggagagcttaactcggttatcggggctttccagaaagcgcagaccgcagaggatttgatgggggcgttcgctgcttgcccgtccttgaatatgctcaatacacgttatattatctataatccggagcaaccgcctttgaggaatccgtttgctttcggcaacgcttggtttgtggataaagtggaggtcgtggagaatgcggatgcggaaatagcggcgttgaatacgatcaatccgttaacgacggcggttgtcgataaacgtttcgctgatgaggtgaaaggtttcacgcctcaattggactctactgctacgataacattggatagttatcgccctaataaattagtttatacgacgaagacgaattctgagcaattagcggtattctcagagatctattatcaaccgggatgggaggtaactattgatggtaagcccgcttcgcatttccgggcggattggatattacgagctatgttagttcctgcgggagagcatcagatcgtatttgagtttagaccgcaaggttatattacggcggcttatattacctctttcagttcgttgattatcttgttgttattgattggtgcggtaggatattcggtttggaaagctagaaagcaaaaagagatataaattccggttggttgtagagacggggcacaccccgtctctacaactagatgaaaccgctattgataaaatcgagcagttttctcgttagggtttcccacgagagagctgctttttctttggatatgttcgcagggatggtggcttgctgtgagggggtgaaaagttcctcgataccttgggcgagggccgttgcggatatctcaggcactacgatgcctgtacccggcttttcgatgctgttcttgaaatcgcctacgggagtacttaacataggtaaatcgtaattgtaggctacggatacgacaccactttgagtggcggagcgataggggagtactaaggcatccgccgctgagaaataaatggggatttcctcgtcgctgatatattcacagtggacgaatatacgttcttttgccggagatgcatcgatcagagcctgatacttctcgaaactaccgtaacattcgccggctataatgagatggtaatcctcgttaagctgtcccatcgcttctatcagcaggtctaatcctttataatcccgtatcagtccaaagaatagaagattctttttggacggatggattcctaatttccggcatgcctcgttcttgttgatcttactcccgaaatgattataaagcgggtgtgggttctggatatatttagcgcccgggtaaagtttccgcaaatcataccgcacgttatcgctcatcacgataaagccatggcattgcttgaaaagtaacgaagctaaaggcttgtcgaagaaacgcggctcatggggaatcgcgttgtggataagggtgattaccttacaatgctttttcatccgatttgctacgtgggcgtatccgggaacgaaaaaggacatccagtaagagataatcagtacgtccggcgcataggaacgaatggcgtttacggtactgaaataactaaccgggttgacgctatctaatactcgcacgctctcgatttcgatcgcacggtctcccgcttctacgtattgagtcttgccgggaaataagatatccggataaagacgtttgaagttgaaagcctttacttcatgaccttcttttactaattccgtatagagcatcccgctgaattgggcgataccgccacgatagggataaatgggggagagaatagcgaaacgcatggtaattgaaaattaagaattgaaaattgaaaattaagaatcgagaactacaggagctgccctcccttcattatcaattctcaactttcaatcttcaattaattagtatctgtaatgatcagccttgtacggtccttctaccggtacgccgatataatcagcttgcttttgtgataatgtagataatttcacgccgatacgttccaagtgtaggcgggcaacttcctcatccaaacgtttcggcaaacgatatacgcctacctcataggccatttgccataaatccatctgggcaagaacttggttcgtaaatgagttgctcattacgaatgatgggtgtcccgtagcgcaacctaagtttaccaagcgtccctctgccaataagaagatggagtttccgttcgggaacgtatatttgtccacttgaggcttgatattcgtgtgcttgatattcggatagttgacaagcttatccacctgtatctcgttgtcgaagtgaccgatgttacatacgatcgattggtctttcatctgtgtcatatgctcgatcgtgatgatatcgcagtttccggtggtcgtaacgaagatgttaccctctttcacggcctcttccatggtcgtaacctcgaaaccttccatagcggcttgcagggcgcagatcggatcgatctcggtcacgagtacacgggccccgtaagagcgcatggagtgagagcagcctttacctacgtcaccatatccggcaacgactaccaccttgccggcgatcattacgtccgtagcccgcttgatgccgtccgccaaagactcacggcaaccgtataggttatcgaacttggatttcgtcacggagtcattaacattgatagccggaaccagcaactcacctttctccatcatctgatacagacggtgaacgccggtggtcgtctcttccgatacccctttcatctcggctaccgtacggtgccaacggctgttatcttcttgaaggatacgatttaatgtatccaggattacctgtttctcatgatttccgcctttgcggttgatagtctccgcatcgttctccgcacgatagcccatgtgaatcagcaaggaagcgtcgccgccatcgtcaacaatcatgtgagggcctttaccttccgggaaacgaagcgccatgtccgtacaccaccaatactcctccagcgtctcgcctttccaagcgaataccggtacgccgtccgctgcgatagcggcagcggcatgatcttgtgtggagaagatgttacagctagcccagcgaacgtccgctcccaacgcaactaatgtttcgattaacaccgccgtctgaatagtcatatgcagtgagccggtgatacgtgcgcctttcaagggtttctgatcggcgtatttctggcgtagcgccattaatcccggcatttcgtgttcggcgatctcgatctctttgcgaccgaattcagccaaactcatatctgccactttataaggcagattagttggaaataattgtgacataaattaatactataaatggttgagacgcaaaggtacgaaaaagcgttgatagtaggtgttctttatctatgaatttccatctagggcagaggcttgccgaggggtaggtgggtttgttactgcaacctgccttgcagtagttctgcaacagccatgcagcattactgcaacctgcattgcagtaacactgcaatgccgttgcagtattggactctctgtagttttgcgatttaatgaatactgaaggctccatctaccaatagcgcgtggccatctacgaagctcgcttgcgggctgcatagccaaagtacggcgttggcgatctcttccggtttgccgagccgccctgcgggaatgtcgcgcaccagctccttctccaaggaagggtcacgccgcattaagtcttccgccatcggcgtacggataacgcccggacatacggcattgatgcggatattctttgccgcatagtcgatagcggcggtacgtgtcagtccgataacggcatgcttacaggctatgtaggccgcttgccccggaaatcccgtgactccaccttgcgatgaggtgttgacgatggcgccgccgccttgtttcagcatttgcaggatctcataacgcatgcagttccagacacctttcaaatccacagccacggtacggtcgaattcatcgtcggtgatttccgccattgggcgttgcggtgtttgtatgcctgcgttgttaagagccgcatccagtcttccgtaggtagctacggtccagtcgatcatctcttttacggcttgcgtgtttgatacgtcgcaccgatatgctacggccttctgtccctcggctactaatttctctacttgttctcccggctcacggatgtctgccaatacggttatgtatccagccttggcgaaggcttcagcgcaagcgagtccgatacccatcgctgaaccggttactaaagctactttctcttccattgtctttgtcatgatcatttgatttacattttgttattatttatgtcgcgaagataaggagggagtggtatagaggctttgttatgtggttcaaatagctttgttgtgtgggccattataaatattatatatcctcggttggcggtacgccatacgctatcttatagattttcgagaaatgggaaaggttcttgaagcctacctcgaaacaaatctccgagaccttacgcccccccttacgtatcagcccatgtgcggcttcaaggcggcgtcggatgagccattcccggggcgagagagcgctacatttcttgaaatcacgtttaaatgtggagagactgcgtcccgtatagttggcgatttcttccatggaaatatcgttcatataattccgctccataaattccagtatgtctatcttccatggatcggtaaaatcgaagatagaggcatatagattcttgtcggtattgagcaacacatagacgccctcgaccatttttagttgaagcaattcgtctgtcggttggatcttggaattgaaataaggggtcatcgactcaaacaagcttacgatatcgggacggttggacggtagcttgtaaaggcttacctgatctcgcttggcgtctttagggagagtatttcgatctaatttgctgtaaaagtcgcgtaggaacttcatggtgaacatcaagaagatcgccttgaactgctcgccattccatgcttgtttcgtcatctgtacgctgaagtccttgcggatgaaagcgcattctcctttatgtaaccgggtgatttggcctttctcgtcgattaccatctctccggagtatacatacaccaacacatgcgaatgattccggtgcaggcagctctttccgccatcgaaatacatcgctaaaaataaatccgagtaacgcagtgtgttgatcccgtccatcgttctttaggaaaatgggcgacacgggaagatcgtgccgcccattatgaggattttaaagtaactgttaactgtccactaaatcgttaggccggcgtgataccttgctcttgcaatagtttcagcccgaggtctttcaacttgaacttctgtatctttccgcttccggtcatcgggaaggtatcgacgaagaagatgtatttcgggatcttatgccgggcgatctttccgcggcagaagtctttcacctcttcctccgtagccgtcacaccatcgtgaaggatgataaaggcacccacttcctctccatatttcttggaaggaacagcagctacttgcacgtctttcacgccggggaaatgatagaggaactcctccagctcacggggatagatattctcgcccccgcggataatcatgtccttgatacggccggtgatccgatagttgccgttctcgtctttcacgcctaagtcgccggaatgcaggaagccatccttgtcgatcgcctcattggtggcggcttcgtttttatagtaacctttcatgttattataaccgcggttacacatctcgccctgtacaccgacggggcattcctcgccagtctccggatcgataacccgtacctcggtaaattcgaactcatggcctacggtattataacgcacctcggccggatcttcgatacgggagtgggtcatacccggtgaggtctctgtcaatccatacacgctggttacacgcatatgcatcttctcgtccacggttttcatgagttcaaccgggcaaagagaacctgccataataccggtacgtaacgacgtgaggtcgaacatctcgaacatcgggtggttcagctcggcaatgaacatggtaggcacgccgtacacggccgtgcaacgctctttatgtatagaagctaataccaatagcggatcgaatttctcgaccatcacttgcgtacatccatgcgtcaatacgttcatggaagctaataccacaccaaagcaatgaaagagaggtacgcagcaacaaagcttatcgtcggcggtgaatttcatatgctcacccgtcaagaaaccgttgttggcgatgttgtagtgagtcaacatgacccctttcgggaagccggtcgtaccggaagtatattgcatattgacaacgtcgtggcaatttactctcgctttggcagcctctaacgtctcatccttgatattttgtccgaggagcaacatctcgggcgtattgtacatacccctgtatttctcctgtccgatatatactacatttctcaagcgtgggaaacgcttgcttttcaaatacccccgttgagaggtcttcaattccggcaacatggtatagaccatgtccacgtaacttccatcaaacacgccgtctgtgatacacatcgtatggatatcggcgttctcaaccagatattccagttcgctttgtttatagttggtgttgatcgtgaccagtacggcaccgatcttggctccggcatataagaaagtcagccaatccggtacgtttgtcgcccatacgccgacatgtgtgccatgagtgataccgatcgccagcatgcctttcgccatgtcgtccacacgcttgttgaattcgctccaagtgaaacgtaagtcacggtccgaataaacgatatattccttgtccggtgtagtctcggcccaatgttccagccattggccaagggttctgttatgtaattccataaaacgctggatttaataaggtgtatagacaactcctaggattcgggccttgttgtcggctgccgcatgtacatgatgcgccacgatggaatcataatagatgctatcgccttcctctaggatataggtgttctttccgtaattgatctctacgacgccattcaatacgtagataaactcctctccctcatgcgtggacaggatgaaatcctcgccttcctcggagggagcgatctcgatcaagaagggttccatatggcggccggacttatcttgcgagagcgagtggtaatccatatgcttgtgcccttgtgtcgcgttgttcgtgaacccgataccatcggcctcgctgtcctttttgcggcatacgaccgggcctagctccgcttggtcatccaagaatgtacccaaacgtacccctaatacccgtgctattttgataagaggggccaaagatggaaaatccaagttaccctcgatacgttcgatctgttcgatacctaacccggagcgttcggctacctcctcgatagagagttgtttcgattcccggatatttttaattttcgcgcctataattttgttgtttcccatgtgtatgatttgttatttatagtcctgtaatgtttgataatttgatactaaacggcgcaaatttacattaatattttattatatctaggattaagacaaataaaaagggcaatacccatttgggattgccctttttaatattttcgagtaagctttttcttactttctgataccaagttctttgatgatagcgcggtatctctcgatgtcagtcttgatcagatagtccaataaacgacgacgtttacctaccaacatcttcaatgatctttccgtagcgtaatctttgtgattcactttcaagtgctctgtcaagtgagagatacggaatgtgaacaatgcgatttggctctcagcagaacctgtgttagtagctgatttgccatacttttcaaataattcttgtttctttgctgaatctaaatacatgattctttttactttaataaattaatactatgttatctaagcggtcgcaaaggtaggcattcctttttgatttgcaatagattctgctatcttttttgtgttttgaagcatgaatgtcatatatatatcgtaaaaatatcgtatttttgcagccaataaattagtcttcaatgcaaaagatcagaaacattgcgattatcgcgcacgtagaccacggcaaaacgacgctcgtggataagatgttattagccggtaagcttttccgtgaaggacaggcagaaccggatcagttcatggataacaatgatctggaacgggaacgaggtatcacgattcttgccaagaacgtgtctatcaattataagggatataagatcaatattattgacactccgggccacgccgactttggtggcgaggtggagcgtgtcttgaatatggcggatggttgtttgctattggtagacgcctttgaggggcctatgccgcagactcgttttgttttgcaaaaagcgattcaactgggtttgaagccgatcgtggtaattaataaggtggataagccgaattgccgcccgtcggaagtgcaggaaatggtattcgacttgatgtttagtctggatgctaccgaggagcagcttgacttccctactatttatggttccgccaagcagggctggatgtccgaggattggaaggagccgaaagaggatatcgcggctgtgcttgatgcgatcatcaagtatatccccgaaccaaagatgttggagggtactccgcagatgttgattacttctttggattattctaagtatgtaggtcgtatcgccgtaggacgtgtacaccgtggcgagttgaaagagggccaagatgtcatgctttgtaagcgtgatggtagtatggtgaaatcgaggatcaaggaagtggatgtattcgagggcttgggacgtacgaaagttgattccgtgcagtccggggatatttgcgctattatcggtatcgatggtttcgagatcggtgagactatcgccgacgtgaacgagccggagccattgccaacgatcgctatcgacgagcctacgatgtctatgcttttcacgatcaacaattctccgttctttggtaaggatggtaagtttgttacttcccgtcatatttttgaccgtttgcagaaagaattggataagaacttggctttacgcgtagttcctactgattccgctgattcttggttggtatatggccgtggcgtgcttcacttgtctgtattgatcgagacgatgcgtcgtgagggatacgagttgcaggtaggtcagcctcaggttatcatcaaggagatcgatggtgagaaatgtgagccggtagagcaattgacggtgaatcttccggaggaatgctctagccgtattatcgatatggtaacgaagcgtaagggcgagatgaccatgatggaaagcaagaatggtcgtatgcacttagaattcacgattccttcccgtggtattatcggtttgaacaacgccgtattgaccgcctctgccggtgaggctatcatggcacaccgtttcttggaatatcaaccgtggaagggtgatatcgaacgacgtatgaatggttcgattatcgctatggagacaggtcaggctttcgcttatgccctgaataacttgcaatcccgcggacgtttcttcatcgccccgggcgaggaggtttacgctggacaggtggttggtgagcataccaaggacaatgacttggtggtaaatgttaccaaatccaagaagttgacgaatatgcgtgcctctggttcggacgacaaagtttccttggctcctcctatcgtattcagcctagaggatgcgcttgagtacatcaagggcgatgagtacgtagagatcaccccgaataatatgcgtatgcgtaagatcatcttggatgagacagagcgtaagcgccaaggtagataatatattcttctattaatagatacaaaaaacggcgggcctttaaaaagcccgccgttttttatatgatgttaggattttagagatccttcaatgagtgtgtatccttcattctttattttccggatctttcttctcttcatccggagtggtaaattgtatcactaacgattcatctttaggagtctcataccaatctccatgtgcctttcggtaatcttggtcaaaattataagcttcgtcgatgcttttattctctatacaccaacggaaaggttgattttccgaataaggaatatccaatacatatgggtatagatccgtattcttgacgtttttacttaccggtcccttcccgttatcaatgtaaggcatgatcagctgagtcgcactatatgttaatgtctttgtaatcccactttccggttccttgtcgaattttctcacattgacatatccattgacatcggagaaaaagggagttagtccattggcgtccttaaatccaaattggttgtggaatgtacagcctttagccagtaactgggcataaacatctgcggtactcttatcggtatatgctgtgatgctataatatatgacagcgtcattgaaatcgaaatcgccttggtttggataattatcttcgaacaagaggaatcctttcttgttcgtttgcgattctatgacgggaggggttaccggctctgccggctcgatggcaacgggattactttcgattagacaaagcatatcgttgtagtctccatcataggccctatagtttgggcagcgattttccattcccagtacatttccttcaaaatcaccttcttgaatgtggtgaatgaagccgtttgctacgtttttctctattttgaaagaggaattaccatattttaaggtatggcctacgtaattatgggagaatgtcccattatctggtactttattgttatccggcccatttaatgccggagtggagaactgtggacggtctgtgcctcgatatacgaagccgacgttgagccccttgtcgaatcttcccaagggtattcgggtatattctcctgcttgggcctttggctgttcttctttggagtagaatatataattatcgccttggttgatcgtattgaagtcagtgacttggatagcaccattagtttttccatagaaggtgcagtcatctaaagtaaggttctccatcttctcggagggatatgtatagaaccaaattttaccatgcatattactgttgcctttggacattcctccgtcgcttatataggttagccaaatatccgctttctcaaagctactggtaaaaacggtttccgtgatttttagatcagaacatctatataaatcttcgcttttcacattgtatgacttttccgggaagtatttgttattgatcagatgaaggacttcatcactgatcgcatttgtagcccgtaaactgcttttggttccgctaccgatcgtgatatcctttacatcgctctcaataagttccccatcccctcttaggatatagagtttctttacgtgtgtaggtacttccagagccatatggatcggagttttaccaattaaataaggatctttgactaaagagccttcctcataaggatattcataataaatagaatatagggtcccttcatgctgagaagatatgttaacctgtatgttctcgaaattctcgaactgggctatgtaatcttcttcttctttggtaggttcttgaggatataccgaggggtcttctccttgataaatgtcatgcttaacgcatgattccataaggaagagcagacaaaatacccacaccatttgtttccagatttgtgatctcataatttctttaccctatttgattaatatttacaacaactttattgaattttgcaaatctacggatttattttataaaaaagtcattgataatcaatatttattttgaagtgttgcaatattctgaaatataggcttgagtgggtggaatataaaaaaaccccatccaaaaggatgaggtctttttcttatttagaaagaatattttctaattattttactaaagctgagaagtcagagttagtcgcatatttagcgaactctaagtcgatagcagcttccttagccaagctcttgtcagcagcgatagcggccttcaagttgcttactacaccgttagcgtcgtttgtacgagcagcaacaacagccttcaagtaagaggtgatagcatcaggtttagcaacaccgttcaaagtctgagaagccttgctgtaatccttaaccaagatctgagccaaagcagcgttgttagtcttaacagaaccgaaagagttaacagccttagcatattcgccttgctctaagtaaagaacgccaagagcctcgctcaattcgtttacgccggcagcgttaccgaacaattgttgagctttagcttggtcacccttcgttaatgcgatcaaacctaagttcatgttagcggaagcgttattcttaacagagttagacttgttaaacatttgctcagccttagccaaatcaccagccttgaatgccatcataccgatgttgttccaagtgcggtagcagttaggatacaattcagaagcttttgtatagatagccatcttttcattgtcgttgttcgtcaatgtagcggcgtaaaggatttcctcgatattcaactcagaaggattgctcttagccaaagcgctgatctcgtcgtcagacttaccgatgatctcgatgttagcggtcaaacgagaacgacgtaattgcggaaggatagtctcagccaagtcagagtaaacagcggagatattcttgatttctttctctcttgtctcaggatcttggtacatagagatcacacgcaatactaagtctttatcttgcaagttagaagcagaaactaattccttgaagccttcccagtcttgagctgtgtaacgagcgtcaaccggagcgtcaactttcatcttcttcaattccttgttcaaatatttcgtagtgtttccttcacgattctcagccaacgtgttgttcaatttgaaaccaccatcaggagaagcgtaagcgctgatctcgatagctacattctggttcggagcctcgtctgcgttcttaacaagatctttccattctttgatagcgtcagaattcaattcttgagcgcgaaggttagcttgttggatcaagaacatgatgttagcgtcatgagcctctttgataatacgttggaatttatcagctgcgatagctgctgtagcagtagctgcgtctgccaattcggaagtagcgataacgccttcaccgatctttacgtccggcaatttaacagtcttgtttttgatcttcgcgtcgaaagtcaaatacaattctgattttttcatctcgggtttgtaagtgaaagaagacttcatagttacgttagcgccttctttttgagggattacttggttgttaccttttactttctcaccttggtaagtgtaagaagtgccccaagcttcgccaccctggtaacgcaataccggagttacagttacaacagctttcttgttgaaccatttagcggggaaagtcgcattgatcgttacaggaactttgcctccgatagcctctagcggctgcggctctgctttaatgtactgttctgccaacggtttcaacttgtttgaacaagaagaaagagttaaaatggctgccaatacgaagaatggcaataaaaactttttgttcataatcttgatgtaagtttaaaatgttactatgttaatatattcacttccaaattatcccttagccattatcgtgcaaaactaaagtatttttttgttatggatagcaaagaagcgataaaatctttttaattaatacttattaatgaatcctaggcttgttttatacataaaatatgggtagaattattgaaaaaatatggctgtgtacctcttgccattcttttcaatggatggtttcccagaactcttattgtatattttttgattaaaatataatcttttgtgtataatgctcctcgccataatgcacggttagaaagtagactccagatgttaattttaggaaatggagtgtagcttgcctgtccgtgatctctccgttttccgacacttttccttgtgccgagtgcaatgtataagtcgctttctccattccatccggcaaaacaaggtgtaccatgcctttctccggaccgagatgaatgagtacctgctcgttcgcctcgagcttttcgttgctgatggggttaccgtattgaatgacgggatcgataaacaaggaggtgctaaaacctgcttgcgtatattcggtagcttgtctccagccgtttttatcatgaacccaagccgtattccgggtcgttttgcctttgggcaaattgtaagcggagaaatacgtgttctccgggacgctcttgagcttatagccgatgtagaactttccgctgacgttcacgggcttggagaaatggatataactttcctgtgaccgatttagggatttagcggtctcaataaacgtatcgtccaatatcgatttattgctataggtgggttggaatgtctccgtatataataatgtagagggcttagagtcgccgctgtaaacggtaacttccacttccatctgtttgtaattcgctccggcaggcggtgttacgaaataagctccgtataaggtacccgcttcggctacttggtaagcttccgcatattcagtgatattggcggggttgttcccgaataaatacgctttttcagacccgggatagagcgtacattcggcgttttcttgattaccggagtcatagatgttgctcaaccggaaacaaggggctgatttatacggatcaagtccctcacaaaccttggtctcgtcattggacgggttcagccaatatttgagctgtctctcgggggtatcgattgcgtcccatggtttcatcaaagagaagaagtaatcatccttcgggctattctcgctggactgcccgccggataacgctccgataatctctccgtcggcattgaataaaggagatccggaggaaccgctggccgtataacctacttcccaagtcttgacatgccaatgagcgttcttgtaaaaaatcatgtttggatctgtcaaggtaaagggagccagatcctcatcggatatactgattcgctttaccgagtattggggatgttggatgcacgtatagggggcaggtcctacctcttgtgcgttccagcccgcgtaataaggcctgtaataaaccggaggtgtggcggtaagttccaacaaggccatgtctgccatttcattaaccgccttgaagtaagtggatgcggtagacatctcttccgttccccttaggatcgggtcgcagaaagggctgttgaagttgaaaaagcagacgatacttccggctattttctcataatcggggtttttcatcgtgaattgcttgttcaggcaatgggaggcggtgagtagataaggctttccgtcattgtccgtattatttatcagggtgcccgtgcaccctacgcttccgtctatgatcaggagaacgacgctttgcccccattgggcgtaatcgtttgtcccatcttgatagcaagctaacggtggaattttaccgatcagtgaggtgttgtctcccggttctaacccccgcaagctccggtagccatggttgacttccccgacggtcagtcttccttgaaaagaggcgttagccggttcttgatattctatgatcaggcgatccccttggataggagagaccggcaataggtttaactccgagttgtttaggtgattgaacgagcctaatatctgtgtctggtcctcattatataggaagagctgggcgccttcgggcagttcatattccgtgaagagcacgttgatggaaagggccccgggcgagtagatcccgagtctccatacacgtgtcccatccggcccggtgaaagttacgcccgagttgtaccgattgtaatccgttatgaatttataggcaaaacggaaaccgcttcttaggtcgctctcattcagcgagtcgatgcgtaactcctcttggacgtcgaacggaggcatttctttaaacatctgtccgtttgtacttcgcatgagcgatagcggaagcgggcggcctccgtggctaacctgcgctttcagatttccttgaaaaccgagcatcgttagcaggaatataatgtataaagaggtcaactttttcatatcgggcaaatataactatatttctttaccccatgatctatatatcaagttttttcgctaagtttgccaatcgaaaagtacggacaaacttaaataaaaccaatatataattaaattctaaagatatggcaacacctccgtttcactacgagccgatgttccaaaagggaccggacacaacagagtattatttgcttacaaaagattatgtttccgtttctgagtttgaaggaaaaccgatcttgaaagtcgctaaagaaggtttgaccgctatggctaacgccgctttccgcgacgtatcattcatgcttcgccgttctcacaacgagcaggtcgcaaagatcctaagcgatccggaagctacggacaacgataagtacgtggccttgacattccttcgcaacgccgaggtagcggctaaaggcgtacttcctttctgccaagataccggtacggctattatccacggcgagaagggccagcaggtctggaccggttactgtgatgaagaagcgctttccttaggtgtttacaagacctacacggaagagaaccttcgttactcccagaacgctccgctgaatatgtacgatgaggtaaatacgaaatgtaacttgccggcccagatcgatatcgaggctacggaaggcatggagtatgagttcctttgcgtgacaaaaggaggtggttccgccaataagacttatttataccaagagacaaaagcgatcttgaatccgggtacattggttcccttcctcgtagagaagatcaagacattgggtacggccgcttgtcctccgtatcatatagcgatcgtgattggcggtacttccgctgagaagaatttattgacggtgaagttggcttctacccgtttctatgatagcttgcctacgaccggtagcgagggtggccgtgctttccgcgacgtggagttggagaaagaggtattggccgccgcccagaatattggcttgggcgctcaattcggtggtaaatatctggcacatgatgttcgcatcatccgtttgcctcgccatggcgcttcttgcccggtaggtttgggtgtaagttgctccgcggaccgtaatattaaatgtaagatcaataaggaaggtatctggatcgagaagttggatagccatcccggcgaattgattccggaggaacttcgtcaagcgggtgagggcgacgctgtcaagatcaacttgaaccaaccgatggcggatatcttgaaggaattggataaatatccagtatctactcgtttgtcattgaacggaacgatcatcgtgggccgtgatatcgctcacgctaagttgaaggagcgtctggatcgtggcgaggatcttccccaatacatcaaggatcatcctatttattacgcgggcccggctaagactccggcaggtatggcttgtggctctatgggcccgacgaccgcgggtcgtatggactcatacgttgacttgttccagagccatggcggtagcatgatcatgttggcgaagggtaaccgtagccagcaagttacggacgcttgtaagaatcacggcggtttctacctaggatctatcggtggccctgcggctatcctggctcagaacaatatcaagagcatcgagtgcgtggaatatccggaattgggtatggaagcgatctggaagatcgaggtagagaacttccccgcatttatcttggtagataacaagggtaatgacttcttcaagcagatcaagcctcgttgctgattccttgatcggtaaagataaatgaaaagcggtatccggcggcaagctggataccgcttttttctaaaaaaaaagtcgtacgtgtttttttaataggttaatcccacgatccacagcggtagtttcttgccggtggcgaactccatattgtcagccaagatgaaggaatcggggagatccgctatttgcttgaatgttttatccgctcctcctacctcgaaggtgtaggcatggtctacgataaagtcaccttttgtttttccatattccacgttatgatttacggataactggttgacgacaaaagtttcccttgccgtcccgatctgtacgggagcggaagctatggcgtacaataggttgggattctgtaggtaaatcttatccggtttttgcatctttttgacagatagtaaatccgagtacaataacttgagcaattccgccttgtccaaattctgtaagtaattgatgacagagtttcgggaaagtccgatcattcccgctagtttcgtgatgtccagctcataaggaacagaggtagctaagatacccatcaaagcctttagcttccgtgtataggcaggatctacgccacacagcaacgggagttcctgctcaataatgagattgaccacattctcgatattaatataataatcttctctgttacccgtaaaaaaggggtaatacccttcgtggagatattcgttaaacatttgtacggggcgacatttctcatttatttcccggcaaatgtttcctggattttccagtatcgtttgtagggaatagacaggtatatcaatttgcttatagaacatgagaaattcccggaaggaaagtccgtacatattatatggtaggcaacgtctggaaagatcggcatccgcattcaatatattcaatagggaagaaccgctaaaaacaattcgtagagatggatacaggtcgtaggcctcttttatctctttactccaagtgggatatttatgtacttcatcaaggaataattgttttcctccttgcaaatagaaccgctcaatcagttcagatagggtgtgattactgaaatagatgctgtcgagcgtgcaataaagtacctccctgcttcccggctggaaattcagtttgatgtattgcaacatgagtgttgtttttccgacaccccttgatcctctgatggcgatcagaggattatcccagtgaatttggttcatgagttcccttatgatatgggtactcgtttgtgccagtaatcgttcttgtttaataaatagactatccatacgctgattgaatgaatgacaaatatacgatttattcaagatagatagcaaaaagtacatggatttgttaagggcaaaaagcaaatctggtgtttttttgttaagagtaaaaagcaaaacctgtaagtatccggtcgtagcgtactttgcgtattggctttcaaaagtttgtataaatatcaatgaaactattacactttaattttttacctttgttgcgtttaagtgataaaacagatttccaatgcctcgtatatacatcctcttgatgtcggtcttgatctcggctttttatgcttgcgatcatcgggggaagccttaccccgctaccctgtcacggatcgaatcccttgcggatacaaatccggaggaagcccgccctttgttggatcgattgcgggatagcctttcgtcctttgatgaggaacagcgtatgtattatgacttgctcgacttgaaggtcaatgataagatgtatgtccggcatacttctgattctttgatcaaacgaatcaccgctttctatgagacatatggcgatcgagacaaattactagagtcttattactatatgggccgtgtctaccgggatttgaatgatgccccggaagcgttgaagtatttccaaaaggcattggatgtggcgggggatacgagaaagtaccgattattgtccaatgtctattcgcagatggggatgctttatgattatcagaatgtatatgaagaggcgatccgtatgtatgagaaagcggctgagtataaattactgaaaggagatagtactagtttttctcttgtgctgagagatattgcccgagtatatgatatggtcgataagaatgacagtgcgcttctctattttcaaaaagcggcaattatagcgaatgaaacaggaaatagacatcgatattccggtatattgactgagctgggtgatctttaccgggaattggtaatgtatgataaagctttggaatgtttgtctgaatcattaaaagattccgtagaccggaatatgtatcctacttattcggttttggggaatacttatttagaactcaataaattggattctgccgattactatttaagaaagtgcctggatagtcctaacttacatgttagagacgctatttatgagtacttgtcgcttttgtatgagcgtcggttgaattatcgggaggctattcgctatgtccgtcttggccagcaagtgcaagattccatccgcaagataaccgattcggaggaaatccgtaaaatgacctctttatataattatcaaaagcgggaaactgagaatttacggctaaagggcgagaatgaccggatgcagattcgtatttaccggatattatccttgttcggattggggctttcgataaccttattgtttatatatagactgaaacggcagaaagagcggttggctaggcagtttgaggcgcttcagcgggaaaagcaagaacaatatgagagaagttttcaatatgtagaagcgaataacgcgaaattgaatgaattgggaaccttactatctaaagaccatgaagatacaaattcattgcttcatgtgcgaaaagaacttttgcaagtgaccaatgaacaaatacagttgcggcgtaccgagcgtgatttgttagagtcggatttaaggcattcggatatctatatgaaattccattccacgaatgaggcagatcagataatcagggaagaagattggaatgctttacggaaggagttagataagacatacaataattttacgaatcgtctatatcagttatattcgggaatgtcattgatagaactccggatttgttacttgataaagatatcagtcaaggtaactgatatggcaaaaatcttgggtcgctccaaaccctccgtatcctcatcccgtaaacggctttataaaaaaataaagggagaggatggaaccccgaatgaactggatgaattaatcgctggtctttagccttatacaactctgcgaacaaaaagcgaacaaaaagcgaacagtgttttagccccgaatccaaccttatcggatacttttgcagtcaaaaaatgaatgggatgaaaagaattttacttttgactttgttgagttgcgtgggcttgtgtacacaaatattgagtgtttttgcccaacaaggagagaaaagtgtcgggataaatgtgggttacggcacagcaagtagttttgagtcgtttcgcttaggtgctgagttcaattggaacgcaacggatcatattcgtttgtcgccttctttcgattgctattttgccagtagtacctcttatgtggttagtgcggatgtacattatttatttccgataaaaaacacatggcaggtttatcctttgctgggagtcacttatactcatttcatgactaatgaatttgggggaaatattggagctggtgtggaatatccgatttcctcgtctttttatgtaagtgccgaagggaaataccagcttacgaaggatttccagcaatttgctttggcggcaggtgtagcctataagttttaataggtcatttgatacatcgttcgacggagtataaagactaaattcgttgggagaacgagatataagaacttcttaggagatggtaacgtcctataaaataaaatcccggatagcgtttaatctacccgggattatatattaatgtataagaccttatcttagtttctgtactccctgcgaggcccgcaatcattacgatcttgatgaggaccacggtctccagacgcttccagccgatctcggaaatgtgaagcagatcatccttgcccgatataaactcaacgaacgtaccgtaaggcataagagaagcgttatccctcaaaaggcatgtttggcaacatgatcctaaattatcagtagtacttaccttgccaacgcagtatatcttctatgccacttgcagtatatatcccatggataagtaagtagtactgacttttccggcatgagaaaagcgtttcccttaggcgaacaaatagtttctcctagggaaaactaaagtttcgtaagcacaaaactaaggtttcctcatgaggaaacaaatgtttccatagcggaaaacttttgttttataccaagaaaaactataaatgtcaattaatcagttttttagatgatatatgaagcatgaccaaatagatagcttgccggctaagcaatgtctccgtcttcggtcgcttcttgaaaaagataggactaataatacggttggcgagtaggggacggtggtgttttgtgattgaaaagtagtaaatggttgtagatacgagccaatagtggtagatgctatttatctaccaccacccgataaataacttatgaccaattgattatagctatagttgtaggtgtggtagatgatttgataaaaaaatcccggatagtgtttaatctacccgggataatatataatgtataagaccttatcttagtctctgtactccctgcgaggtccgcgatcaccacgatcctgacgaggaccacggtctccacgatcttggcgaggtccacgctcacctctttctggtcttggcggacgttcctcgtaaccttccggtttcggaagcaataccttgcgggaaagtttgaacttgcctgttttcggatcgatatcaaccaacttgacagaaaccgtatcgccttccttcaagccggcttgctcaacggtctccagacgtttccaatcgatctcggaaatgtgaagcaaaccatccttacccggcatgaactcaacgaatgcaccataaggcatgatagaggaaatctttccttcataaacctctccgatctcaggaacagcgacgatagccttgatcgccttgacagccgcgtcgatcgtagccttattcgtgccggagatctcgatctttcctacgccgtctacctcatcgatagataccgtagctcccgttttctcttggataccttggatgatcttaccgcccgggccgattaccgcaccgatgaattccttaccgataatcatcgtctcgatacgaggtgcatgaggtttcaaatcctcacgagcttccggttgagcctccaagatcttgcccaagatatgcatacgaccctctttagcttgagccaaagcattctcaaggatctcgtaagacaaaccgtctaccttgatatccatctgagttgccgtgataccgtctttcgtacccgttaccttgaagtccatatcacccaagtgatcctcgtcgcctaagatatcagacaagatcgcgtagttcgtacccttgttctcggagatcaatcccatagcgataccggataccggtttcttcatcgggacacctgcgtctctcaacgccaaggtaccggcgcaaaccgtagccatagaagaagaaccgttagactccaagatatcggagattacacgtactacatacggatagttgtccgggatcatacgtttcagcgcacggtgagccaagttgccgtgtccgatctcacgacggcctacgccacgtgttgctttggcctcgcctgtggagaatggggggaagttataatgtaaaaggaaacgctcgtatccatggttcaatacgtcgtctatcattttctcatcagacttcgtacctaaagttaccgtagataaagactgagtctctccacgtgtaaagatagcggaaccgtgaggacccggcaggcaatctgtctcgatccagatcggacggatctcggtagtcttacgaccatccaaacgcttgccctcatcaaggatggcacggcgcatagcctctttctctacatcgtgatagtagcgaccgatcatttccagtttctcgtccgtcaactcctcctcggagaattgagccttgtattcttctacgattttctcgaatgcctcgctgcgttcgtgcttgccgctaccggatgtggctacggcgtaagccttggcgtaacatttgtcgtgtacgtccttgcgcaactcgtcatcgtttacctcgtggcaatattcgcgttttaccaatttgccgcaagcttcggataactccagctgagccttgcattgtaccttgatagcctcgtgagcgaccttgatagcctcaagcatctcagattcctgaacctcgttcatctcaccctcaaccatcatgatgttgtctatggtagcggcaaccatgatgtcgatatcagctttctccaattctgcggaagttgggttgacgatgtattttccatccgtacgagctacgcgaacctcagagatcggtccgttaaaaggaatatcagaaactgccaaagcggcggaagcggccaaacctgctaatgcgtccggcaaatcttcgccatcagcggagaacaatataatatttacatatacctcagcgtggtagttgtctgggaaaagaggacgcaacgcacggtctactaaacgagatgtgaggatttcataatcagaagcttttccttctctttttgtaaaacctccggggaaacgtccaaaagcggagtatttctctttgtattctacttgcaacggcatgaagtcaacacccgggttcgcgtctttagcggcacaaacagtggcgagcaacacggtgttgttcatacgaacggtaaccgctccgtccgcctgtttggccaatttcccggtttcgatggtaatggttcttccatcacctaactcgatcgtcttgttaattggattaagcataatcttttttcttatttttctatctgtcaaaaattggtgcaaatgtaatgaaagtttacctgtaattgcatgaaaatgaaaagaaataacagtcttaaagcactttttttgaaaaaagccttgaagaaatacggaataatagtgccacaattgtaaaataatgtatatttgcaccggattagtaatatagacaaactggaataatgaaacaaatatctacgaatttactagctgtgctgtgtgttatgttgcttttgttcacggcttgtaagaagaattctgattttacggtggaaggtgtagtgtccggcgcagacggccagatgatgtatctggagaatgtaggtgtgtcgacggtagagttgatggactccgtaaaactgacggcggccggtaaattcagctttacgaagcctcgtccggcattcccggatttttatcgcttgcgtctgaataaccaattgatcaacttctcggtagattctacggagacgatctcgttcgtggccgatgccgggactttcgctacttcttatagcgtggagggctcagagaattgcaaggcgatcaagaatattactttggctcaattagatgcgaaccaagcgatccatcgtttacggaaagaatctgagtccggtctgttggcggattccgtatattcccgccaggtgctcgaggccgccgaggcttataaggacgtggctcgtaagtatatttattccgccccgatgtccgctgccgcttactttgccttgttccagcaaattgacggcttgctgttcttcgatttgtatgacaagaacgactcgaaggcttatggcgccgtagccaccagcttcgatcactattatccggaaagccctcgtgctaagcatctgtataacttggctcttcaatcgataaaggtgattcgtagccagcgcccgatggacttggataaggtggagaagaaagaggttagtttcttggatatcgagttgccggatgtacatggggaaaacacgaaattgtcttctgtcgctacaggtaaggtggtgttgatcaacttcacggcctatatgtccgaatggtctcctgccttgaatatggaatttggcgatttatatacgaggtaccacgataagggcttggagatttaccagatctctttggatagtgatcttcacttctggaagaacgccgcttctaatttaccttggacttgcgtgcgtgatccacagtcggtttactctcagaccgcagcgttgtataacgtgaaacagcttccggcgatctttatcttggatcgcaagggaaacttggttaaacgggtggatgacgtgaagaaacttgaggctgacatcaagtccgtgttgtaaattgttcatgatttaatcatcagatttatatgttataaagcactttcgtaaacttgttcatcttagaaagataacctaactttgcggagtcttgaaatgataaaaaaggggagttccggccatatgacttggtcgggattcttttttattatgcgataatcaatcaatattaatataaagaataaggaggatttagtatggctgttagttatatgacaaaggacggctacgataagattttagctgaaatcaactatttggagaccgtgaagcgccctgaaatatcagcccagatcgctgaggcgagggataagggtgacttatccgagaacgctgagtacgatgccgccaaagaggctcaaggtatcatggaggctaagcttgcgcagttaaaaggtttgatctcaaacgcccgtctgatcgatgagagtcgtgtgaaaactgatgaggttcagattttgaacaaggtgaaaattaagaatacgaagaataacgctgtcatgacctacacgttggtatcggattcggaggctaacctaaaagaaggaaagatctccgtaagcacgccgatcgcccaaggtttgatgggaaagaaggtaggggatgtcgttgagatccgtgtgccttccggcttgatgacgtttgagattatggatatttcaatttaaaaacagaaagacgtatggcaactattttcagtagaatcgtggcgggtgagatccctagccacaaggttgcggaagacgatgagttttttgctttcctcgatatcaatccggtagccttggggcataccttggtaattcctaagaaggaggtcgattatatctttgatatcgatgatccgatgctgggacggatggtagctttcgctaaacgggtagctcgtgctcaagagaccgctatcgagtgtaagcgtgtaggattggctgtcatgggtttggaagtgccccatgcgcatatccatttgattcctatcacgaaggagtccgatatgtatttcggcgggaagaaattggctgtaagtcaagaagaattggccgagatcgccgctaagattagaaaagaattcaaataattgaatataattttttaattataaaaaattggttatatttgtacccgctgttttatgcgtgacaatatcatgcaaaggggacagcaaatcattaatatgattcattagtggtttttactcataaatttgttaaccttagaagaaaggcccctctgtgacagagcggccttctttttttaaacacacaataaacattataaactactaaattgatatcttcatcttacatcttcgaataggattaggggagccaaacggcatgcctgttccaaccgtgtacaccgttccagtaatcatgccagtcatatagcataccggattgatggatatatacgccacataatacaagggagataagccataaggctaataatatccatcttgcttgcgtcggtaagggacgtaccttgaacaattggcagcaaatcgcgtatatcagggagaatatggggatgccgatgaataagatcgtccctatgcatcccatgattgccattgacagcggtgctccgtttatcaagtccgctccgaacggagagagattatagatgaatccggctccacccatgagcaaagcgaatgttacgactaccagaatgaatacgactagtactagcggcggcaacaagaagattccggctaatatgatgaaaaacttcaagatgaacccgatgaccagaacgaaaacatccgccagcttttggaagaagttcctcggcttatccgagctgatgaagtcgttcacgttattgctgactttctcgaatccatctgtcacggtctttccgatattctccaccgtcacgctttgcccgcgcatctcgagtttctcggtcgccgtgcgtgccatcggtactatgatccacaacaagaagtaaagcggaaccgtgattccatagaagaacatcagaaggaaaagcacgatacgtacggcagtcgggtcccaatccatgtaggcggcgaaacctccggcgacacctcccagaatacggttgtccgggtcacgcatcaagcgtttcttggtcgtctgggcatgagtctcctgttgttgcgtccggtaattatcctcgtggtcggtgcttttctcttcctcctcgaaaatctcttccggcttacccatccgtttgatcacttcctctacctgctcgatcgtgatgacctcgtagcctaagcggacacgctcgttaagaagttccgagatacgcatctcgaaatcatccatgatctcatccgaaccctcttctttgcggaagtggatgcgcaggttagacagatatttgtctaataattggtatgcgtcttcgtcaatgtggaaaactgtgcctcccagattaacagtaagtgtcttcttcatcactctttcgttttaattgtttctgatgtggtttattgtatcatttagttcctgccatgaagcctccagctcgccgaggaatagttctcctttctcggtcagttggtaatacttgcgtggcggtccttgcgtagattctatccactgataacttaatagctcgctattttttagtcgggttaaaagaggatataaagtgccttccacaacgatcaacttcgcttcttgtaacttctgaatgatatcagaggtgtaagcgggttcctttttgagaagcaggaggatgcaatattccagcgtccctttcctcatttgtgattttacgttctctgcattcatctcttttaattttatgctacaaatgtatgtattacatatgtactatgcaatacatgctactatgaattattattatttaaccgaatacttgcacaaaaagagcaattatgtgtaaaaaaaggactgatgtcgtgtcttttagaagagaaaagcgtactttcgcggtatcaattcaaaataaggaattatgatttattatcatttcgccgagttaatacaccgtcaggcagagaaatatgggaaccgtacagcgttgaaacatagagataacgctacggggaaatggttgaagatttcttggagggagttttccgataaagttatgcttacggccaaggcgatggctgagttcgggataaaggtacaagagaatatcggggtttattcccagaatatgcctcagtgtttatatacggacttcggtgcgtatggtaaccgggtggtttccatcccgatgtatgcgacgaattctccgggacaaatcgagtacatcatcaatgacgctaagatccgcacgttgttcgtgggtgagcaattgcagtataataacgctttcaaggtacagaaggactctaagtatctggagcgtctggttgtctttgatccggcggtcaagatgaatccggaagataagacgtccatttattttgatgatttcttgcgcttgggggataatgcgcatgcggagagcacggtgaaaatacgtatgacggaagccgttccggaggatctggctaccattatatatacgtccggtacgacaggtgagtcgaaaggcgtaatgcttcctcattcttgctatctggaggcgatgcggatacatgatgtacgtctgcctctggtaaccgacaaggatctatccatgagtttcttgccaatgactcatatcttcgagaaggcttggtgttattattgtctccataaaggggttacgatcgctatcaaccaagacccgaaaatgatccagaagacattgccggaggttcatcctaccttgatgtgcaatgtgcctcgtttctgggagaaggtgtatgcgggcgtgcatgagaagatcaactccgcctctccggccatgaagaagattttcttggatgcgatcgagactgggcgaaggtataatctggagtataagaataaaggtattccggccccgtgtagtctgaagttgaagttccaattttacaataaaacggtttttaccttattgaagaaggtattgggtattgagcgtggacggtttttcccggtggcgggcgctccgttatcggacacgattaatgagttcttgcagtccgtgaatatcccgatcgcttatggttatggactgagcgagacgacggctacggtttgtttctacccggagatcggattccagtttggttctattggtgaggtaatgccgggagttcaagtgaaaatagatccggggaataacgagatcttggtgaaaggcaagaccgtgatgtccgggtattataataaaccggaggagacgaagaaggctttcaccgaggatggtttcttccgtaccggcgacgctggtcgtttggagggtaatacgttattctttacggaacgaatcaaggatttgtataagacttcaaacggaaaatatatcgccccgcaagcgatcgagatggtgatgagcggtgataattatatcgagcaaatcgctgttatcggcgatcaacgtaagttcgtgagcgccttgatcgtgccggcttatccattgttggagaagtatgccggggaaaaaggcatctcgttcgagagccgggaggagttggtgaagaacaaggatatcattcgtttcatcgaggctagggtagaggagcaccagaagaacttggcttcttacgagaagatcaagcgctttaccttgttgccggaacccttcatgatgggatgcgagctgacggatacgctaaagttgcgccgtccggtcgtattgcagaagtacgctaccgagatagaggcgatgtacgaggaataacgagtttgtcggctatcaactatttcttatcttcgcggtaaatttaaaaaagaaaagaacatatgatcacatcagaccaactacatgacgtgttggagcgcgataaggcgctgagggggtatctttgacatcgatagcaagaccattcagttagaagaggaggagctacgtacgcaagaccccggtttctgggaagacgccaaacgcgcggaagtccagatgaagaaagtaaaggagctaaagaaatggatcgagctttacggtgaggtacatgcggcggctgaggagctagagttggcttacgaatatgtaaaggaagagattatcaccgaggaagaggtggacgcggcttataagaaggcccttcatttactggaagacttggagttccgcaatatgcttcgtgacgaggccgatcaaatgagctgcgtgctcaagatcaactcgggtgccggtggtaccgagagccaagattgggcttccatgttgatgcgtatgtatcagcgttgggctgagaataacggttataagatctctatcgccaactatcaggaaggggatgaggccggtatcaagaccgtgaccttcaatattgagggcgattatgcctatggctatctaaagagcgagaatggcgtgcatcgtttggtacgtgtatctccttacaacgcccaaggtaaacgaatgacctctttcgcctccgtattcgtcaccccgttggtggatgatacgatcgaggtaaaggtagaggcggcggctatctcttgggatacgttccgttcgggcggcgccggaggacagaacgtgaacaaggtggaatccggagttcgcttgcgttatcagttcaaggacccgtatacaggcgaggaagaagagatcttgatcgagaataccgagactcgcgaccaacccaagaaccgtgagaacgctatgcgtcaattgcgttccatcctttacgataaggagttgcagcatcgtatggccgagcaggccaaggtggaggccggaaagaagaagatcgagtggggttcgcagatccgtagttacgtattcgatgaccgtcgcgtaaaagaccatcgtacgaactaccagacttccgacgtgaacggtgtgatggatggaaagatcgacgatttcatcaaagcatacttgatggagttcgccggagaagaaagctcggaaaaataagtttttccctttaacatttgcatatctcgataataaatcgtaatattgcacccgatttcagagcctagctctgaacaggtcctatagctcagttggttagagcacctgactcataatcagggagtccttggttcaagcccaagtgggaccacgatggatgatcgctaaataacgtaatattagttatttagcgattttttattgtacctgcatgaactaaaaaagaatatgagtgtttgaggtcacaatttgtgatctctttagagaaacgccgccgccctcgtgaatatggaatgaaaggcttggttgatcaggcccggatcgatacgggagtgtgtcgggaaggggatttgatgggagtaagcgaacgggaaatccagctcttccaatatcttgccggacgcttttcctaaagccttgatcaccccgccagtaggcataacgatatcttttttcaatgagatcgcccgaatacgatcgcaagcccgttggaagaacgactcccggtaatctcgtaacacatcctcacgtaccatggccttaaaggcttgctccagaaaatcattcttgaacgaggtgggaagcgtacggttctccaagaaatcatgccggaagtaatggcgtaccttggcgaacgcctccttgtccatgatatcacgggcgttgccatccatctcactgaagatggagccaccgcaaaacatgaataaacgggtgtccgtaaacatcttgtccggattcgctaataacaagacctgcgagagtaacgccccgatggaataagcgaataagttgatggacgtatcttccttgaacaaaggatgcttgccgttcttgatctcatgaaccaattgccacatattataaacggactctctgcccgaggcgtaaaagcgtaacgggttttgggatagccggctgctgagggctacgttggcgaaggtggagttcgtcacgttcgctacctcctccttgcgtttgcttacccaagggaggatcgcacggggattggcccataatcccggggtacggttcatatggaaagcgatcgggaacaggatgaccggcttaccggtcgtatgggtgaggtattccgcccatgtgaggtatttttcccaagtccgctcgttcaggccatgcaacaggataatcgcctcattattctttttacgtccagagggcgtgaatatggcatatgagaaagatttgttctcttggatacgatcgtcggtcatcggacagaatccggtgggggtaagtcccttctggaactcgtcgatctcgctggcgccacgggtctgggtgaagcgaaacgggatgatctccagatggctctcttccaattctgtctttttgtcataagagaaaagactgttcagttgcttagtacgaagtgaaatatccataatcctctgattttttactgcaaacaaacaatagaaaaacatctcttcaaaataaatggtttaaacgggctttgttggggacataaagtgttatttaggggtgaaatcttttatagaggggtgaatttcgtctgggaaaatgattacatttgttccaaaatagaggcaaaaagatgggaatgtgggatcaaaaaataccaagttacatatacggtaagcagaatatcgtgaggctgatcctgtggacggccttgttcgcgttggtgtttatcaacatctacaagccgtttagctccacctcttggtacaaggtctcggagtttaagttcttcgtattctctagcttgattatcttgacgggagtattggtggttgtcttgagccgtattattctgttccattgggggaagcggcatgctatcacggtccggacctatgcgatctggatcgtgctggagatattcttcatgtcgcttttctatacgatttatacgttggtactgaatccggaacgagaatatatggaagtttttaacgattcggcggtgaataccagtctggttttattgctcccttattccgtgctgcacctgtatttctcttataaagagaaagagcggcaattgcgattgttggaggagaaccagacagaagcggcggttcggcaaagcgttttctctttctatgacgagaagaacgagttgcgcctttccgtgaagcgaagtaacctgctgtatcttgaatcggcggataattacgtttgtatctggtatctgaataaggggcagctcacgaagtttatgcttcgcaactccttgaaggcgatcgaagagagcctcgctgatacgaatgtactccgttgccatcgttctttcatggtaaatttcgaccaagtgaaggtgatccgcagggagaaggagggcgtttatctggagctggggatcgagaaagtacccgatatcccgatctccaagacgtatagcgagaaggtaacccgctggttccagacctattcttcctagcgggctatttcaattcgatattattttctttcgcgtattgcgaggggctcatgttgaattgcttggagaaggcccggctgaaataggattgcgagttgaaaccaaccgcctcggcgatctcgtaaatcctcatatcgccttgaaggattaactcggcggctttctttagccggctgatcttgatcaactcgttgggcgttacgttcgacaggccgttgattttacggtaaagggtcggacggcttagattcatcaagtccgctatcatgtccacgtctaggttcacgtcgtttatatggctgtcgatgatatcgttcagtttcttcaagaacttctcgtccgccttcgtgtaagccatggatttgatattggcaatcggcgagttgaaataataggcacgcatattgctccggttgttcagcaggttcgtcacttgggaaagcaatagatccatggagaaaggtttgtcgatgtaagcgtccgcccccagctcaagcccttccatgcgagattgcaaggtgttcttagccgtcaggaggatgatcgggatatggctgaactccagattagtctttatctttttcaataaggtgaaaccatccatgacaggcatcatgatatcgctgatgattaattggatgccatattcctgaagacgggcaatcgcctcctcgccattaccggcggtgacaacattgtaatggacattgatctcttgaccgatgaaatggagcatttcggtgttatcttccaccacgagaaccgtcgggcgggattcttgggtgacatatttccgctcgctggcagggttggtcaggacctctgctttctcttcctctagttttaatgagttcggttggttcaccggcaaacgtaatctaaagatgataagcccagtcggagattcctccaacgtcaacgatccctcgtgcatctccgctaaagaacgggccaagggtagtccgagcccggtcccggatttatggatagaggagtcatcccggtagaaaggctcgaagatcttttcttttatctcctccgagatgggctttccatcgttcatgatatcgatcgtgaatcgctcgccatcttgcgtctcgaaccggacgatgatcttgcttcttgcgtatttaatagcgttcgataggaggttgctgagtatcttcgtgcaagcctccttatcgataaaggcgtagaaagatttcacgttacactcgataatcatttgcaatgcctcctgctccgccgtatcgtggaaacgctcaaaggtctcttgcatcaatgcgatgatgtccgtatgtatgaagtttagtttatatccctcgatttccgtcttcctgaaatccagtagttgattcaccagatccagtagccggttcgcgtttttatccacaatcgtcagataattctttgcgctgggagatagcttgatgtcccgtgttactttctccagaggacttttaattaaagttaggggcgtacgtatctcatgagcgatattgatgaagaaatcaatcttagcttgataaagctccttctccttttcattctcgaactcctgtattttctgctgtatattggccttattatgccgggaaatgataaagatcagcaacactacgcatccgatagcgataatcccatataggattaacgccttggtagagagccaccatgggggaaggatcgtaatctggaacatcgccggctcatcattccaaataccggacaggttcgtcgccttcaccttgaacgtataattaccgggcggtagttttgtgaaataaacccggttctcgcccaccacatgataccatttggaacttaacccttccatgcaataggcgtattgggtgaggttgggagcttggtagcttaatgatgtgtagtcgatgtagaatgtggactgattatgttctaaggtgattccttttttaaaagtgatagcctcttggtgtaagaagttatgatctggatcattataattaatctgtgatatatatactttcggttgaatggaaaattcttggatactattaggttggaagctaatcatcccctttagtgtcccaaaatataatttgtcattatctgtttttaaagaagagttataattgaattgatttgaagttaatccatgttcttttttgaagacttttattttatggtttttagggttgagtcttgcgaggccgttagccgtactgatccacatgtttccttttttatcttcttcaatacggtaaattacattgctaggtaagccatcttgcatatcgtatttggtcgtttgttgagtactacggtcataaattttgattccgtcaccagttgcgaaccataagttgttcttacgatcttcataaatattgtttattgttcggcttgtatttactgtatctaatttaaattctccgtgttgggaagtagcaggattataataatatagtcctttactcgatgttccagcccatattactccatcatgatcttcaaaaagagtttgtatcctacaattattaggaaattggcttaatttctcaaaaatgtctttttgagaattatattgatagacaccaagagcggtagctaccagcaaatcattgttttggagtttataaaggtatacgatgatgtcgtttttgtttgcataaggatttacggaaatcgtgtaatgtttgattattttctcagtacggatatccattaaatcaataccattagcgtgtgtccctatccataggtgattatctatagacgctaatccatgtatacaattttgtgaaaggcctttcatgtcattaaaagatgtatatgaatggtccttcatgtttagcttattcaatccagcgtcttctgtgccaatccatagattattatttttgtctatgcaaatatcgtgtataatatctccattgagcgttctttgtccaggaatattatagtgccttttgaattttgaataaggaggagagtagctgataccgccattatcagtacaaacccagatacctccttcttgatctttgtagagttctttgatagcattgctggataatgaatagaggtcacttttattttgctggatagacattatcgtatcattttgaatatcatataaatatatgccattaaaagtgccaatccatactttctcctttgtcatacgaatgatatttctagtataaagtggagattttttttgttgaggtaaaatatctttatatgtttttgtctgtatatcgattcgttttataccattatctttagttccaattaataatatattatctaaaggagaggcccatattgctgtcatatcatcgataggatgatttttatctagattcttgatatctaaggctatgaattcatttttgtcatcatctagaaaaacgacattaccattcgctgttgttgcccaaatttggtcttgaggagttatataaaaggaggtaataggatcacttcctttatacatataattaagatgcataccttgactttcattgtattttacgagtgagtacccattaagaatcatccagagatttccttgctggtcaaattgtagtgaataacagttgattcctttggtgaaatcaatgagtgtgaaggaatctgtttgatagtcatatttttgtagcccaaggttggtacttacccaaatttgtccggtgggacttttcgctaagtcaagaatataactgctcattaaagagcctttttctgaagagtagctcttgaatgtatagaattttttgctgtcaaatctattgagcccatctctggtaccaaaccacataaagccatagtcgtcttgtacgcaacatgtgacatgattattacttaatccgtcttccatgtcataggacttaaagtagaatggggttgcattcagttctactaagaagaataagcataatagcacaatttgaaacttcatgagctgttgatgttttccatgtttcgtttgcaagatatcaacttttttgatttttgcttttgtaaattagtttcattctttttcatatagtctcaatattgattttcagattccaatttcttctaattctagttggtttataggtgtgttgatacgaaaagtaacaattttgatatgattgaatggtttgtttttcaatatcaatgatacatttgcgacaagttctttaatgagataagactagtaacgttaaattaatactatgttaatatgaagaaacaaagtgtatttacaaccgattattactcaatattttatagataataagtcagaaatatggttgttatttttaattgcacattctaaaaggtgaagatttaacgcttttattgattattaactcaaaaaggacatcaacttgggtcgtttcttctcttttccttgctattcgtttccgatattccacttttgttttggtctatctcatatgtactgcaaaggtattgatttttgtttgatattgctccttgcttgctccttgtcgtagattaattttcacacaggaatttttgttctctttctataggggcttgaaacaatccatttattggaaacaattaaagacggagctggtttgccccagtgctttttaagaaacagggcaattattttatctccacaaaggctcttgttcccaattatgaggaaagcctaataaacgagttcttactgatgggtatttcgataaaagctgcttgaaatctgcaacaaaagtgttgcccatagaaatggagttaagccaatacaccacatagcagagttgcggataaagtgtttgttcacggaacgagaaatccgtaatccatgtgtttggcatacgcataggcatcattggcttgacaggaaagacccgatttgacagtcttgaatgatgggcgcagcaattacgaagtacgggtctgggtacggattaaaaggctaagtgattatttccagtcatttagcctttttaattatctaatttttccccacattttccccacagctgtctatttatatattttagaaacatatttttccgtaaagttatgtacctttgtcggcaaataaagatattctcgtcaaacaaatataaataatataaacatggaaaaaaacagaaaaaaacaaatcgtagttttgagtatagctttagtttgcattttcatcttggtattttcattgttccataaatcagcgacaaaagatagcgcaaatcctcctttaacaaatgttttgactgatagcatttctcaaattgtctcagcttgtcctggcgaaattggtgtggcggttattgttaataacagagatacggttaaggtcaataataagagtgtttatcctatgatgagtgtgtttaaggttcatcaggcattagctctttgtaatgactttgacaataaaggaatttcacttgataccttagtaaatataaatagggataaacttgacccaaagacttggagtcctatgctgaaagattattcagggccagtcatatcattgacagtgagagatttgctgcgttatactcttactcagagtgacaacaatgcaagcaaccttatgtttaaggatatggttaatgtcgctcaaacagatagttttatagccacactcattcctcgttcaagttttcagatagcttatacggaagaggaaatgtcggctgaccataacaaggcttactctaactatacatctcctcttggtgctgcaatgttgatgaatcgtttgtttactgaaggtcttatcgatgatgagaaacaaagtttcattaagaatacgttaaaagaatgcaaaacaggtgtagataggatagcagctccacttcttgataaagaaggggttgttatagcgcataagacaggttcaggttatgttaatgaaaatggtgttcttgcagctcacaatgatgttgcctatatatgtctgcctaataatatcagttataccttagcggtatttgttaaggatttcaagggaaatgaatcacaagcgtcacaatatgttgcgcatatatcagctgtagtatattctttattaatgcaaacttcagtaaaatcttaaactgcacttgctttgataattaatgataaacaatctaaaagcactctaatcgttatcggagtgcttttagattactaatcaaattgcttctattataatttgaatcctctactttttctttcttcctgttgcggcactcttgctccatatctaagcctgtgccattgctccctgaaccagtcggcaatcggcttcctgtttattgtcaggttcagcctgctttcatcgtcagggtcattttccacccttaaaatatcatcctttatatcaaagttccgcctgtgttgctcggaatagattttaccgctacatttcagggcttcttttttgactataagactttcagtcatttctttagagaatcccagcatggcacaaaacttttccatgcgcagcatttccctgaacatcggaaaccacctgaaagccttgtctatgattctggcgagccgtgacagttctttttctttcatgtcaagttcctgcctgtgcatttctctgagattgtggatttgcgtatcatgctgtttctgcatctgctgtacttggctctgcaatttttcaatattggtgttccgttttgaaacctcgtcttgcagtttttcgttggcacgttccagttctttcagttttccactcccgaaaagagaagcaactccactagttatggctgtcgctgccgtggtggctgtcttctttaacttgtcagtgcgtatttctgatttcacctgtttcagttcctgctcggcaagatttatctgttcttctttgtgccgtttggctgcatccatgcgttgcagttcagctttctgcttctcaatgataaagtcgttccgttccagatgctccttaccagtgacagcctttgactgcccgcgttccatcagcaggatgtcggatgcaagggtctgcatctgcatcatgtcatcgtcattgagctttcggctctttcctgtttcgtggttcatccagtcgaaaacgatatgggcatgatagttcggcttgaaccatctgtccccgactttgaagctttccctgtcttccgcttccggctgaccgttcagccaatgcccttcatccttgtgcaggaagatttgcagcggtgtgattccccagcgtctttgacactcctcaccgaatttacgcacgtctgccagtgtggtgtccgacctgacaagcagcactccttcacgtatgggggagcatcccgcaatcttgactattttaccgttcttgcctttgcgttcacgctccttttcctgcatgacacgtccggtcttttcctttaccatctgtctgatattgtcataatgcatccgcaaatccggactgccgaagtcgggatttatccactgttcgttatcggtggatagttcaggaacgacatagattctggactctccgatgtggcgcatgtattcggcagtcctcctgttgtgagcctcgctcgatgcgatgttgcagggcttgatatgtatgcttgattttgttgccatagatacttgttttttggtttgtactttattgtttgcttttccgctgtccgtaaacgcatggggttcttaggggtgcaacccataagcggagattgcaaagagagggtcactctttgctctgggttctcaggggagaaacgccctgagtgggtcattagggtaaaaccctaatcccctcgggagagcccacaactacgtaagcggagcgtgtagttatagtgggctatatcaatggcaagccattgtctgcaaactccagcctacggcttccgctctcctccgtcagggaggtttttcatcatcgttgccgattggagatgcaccgaccagcacaaggtctaaatcgtctatcagtttttgcaggacgggattcttctctatcatccgctggaggattctctcagcctcgaccaagtggttggctgtactcatcaccttgccctcccgtatctgaaagataatccaatcggctatgtcgatatgggcttctttttgtttcggggtggcattcctttcgatgatgtccgaaaccaccaccttacaaaagtacatgctctcggctcgctgtttccactcggcataagcatcggcatcgggaaagagaagcacggttcgccctgacagtacacggagtttctcttctctcatctgactcttaccacccgtagccagccatacataatcggggaagatagcagaaccgataacggcactcttctcggattccaccaagaccaccaccttgtcgggatgcgttttcaacaagtgttccccgaaaaggcattgggatagttgccaatcctctgccaacacacgctgctttttcaatatgctgtgtatccagttcactgccgatgtctgtcctcccttgatacggtgtccgtcttcgggattgtactgcatcacctttcccgtgcgtaccttgcccgtcctgtctatctgccaaaagataacagagccgtcacgggtagcccccaaacggtattcctccaacaaccgcttcaacacctctttcgccttgtcgccatagtaggaagtaaggagtgtgaagaggaaacggaagaaattgctacgctcgctttgcgacttctccacatagtgagggggaatatagccgatggctgtcggcttactttgctgcttcactttcttctgctctgctctttgcctgtcaaaagagaaatcattggtagttctgtgttcaggatgctcttgaaaatactctttcggagtgtagtgatacccacaaccgctttcgtggttacatctgccgaccgatggatgcaacggcacattattttcgtccacgtaatagacgaaagaatgcctgtctccgcatttggggcaggtatgccgtgttgccgttcctttatacttctgtaatgaataattgcccatagcttagtccgtttttgatggttgattgtcggctgtcccatcctgtcccattgtcccacactctaagggttgggacagtgggacacttgggacacctgcgtttttactctctttgctgcgctggatgatacggtttacggtggacttgccacaattcacctgtgaggctatctccctgacggacttgcccgattgggagagttgcagaatttggcaatccctttggcttgattcattgtcgcccaattttttcaagtgttccttttccgtggaatagcccctgaacacgaactgcaagaaagcatccaccttgtcaatctcgtaaacgattacattatccgcatcatgagagaacgtgccatagcgcactttaagctgcttcacatagcgaagccctccgtcttgggcactttttccaatggtgaacacgctgtcaaagaaattgtagagccgtttgcttccggcaaggtcgttggatgtgatgggacaatccaaagagcgtttgggcgtatgtgctaggacaaggatagagagcgcatatctctttttgagattgttcagctgaatcatcagccgtcctgcggcatcgcctttctccatggcgcaacacaggtaggtaagattgtcaatgatgaaaatcttgcagtcggtctgcacagccatctgttcaatgccgcctatgatagcttcctcaaagttggcatccaaaagctggttgcagtcaatagacacccgatagagtttgtcgggaaaggtgtagagctctccatgctcgttggtatagcggagctggaactgcttttcggacagttcaaagtccagatacagcacattgtcggttcgggcgatgcggtcggctatctgcacggcaaggatggacttgcccacgttggaatcggcaaacaagcaggagagttccccctcgtaccaaaagctgtcccacagcgcacggggcgtaggcaataacgatgcttcaagaatggtttggtttgccgtcttgatattcatcatgcctacactgtcgggcataccgttatgcgcttgggatgcttttgtgaggtcgccacgtatcaggttgatatagttcttatcctcttccatatcattcaccagttacgtgggttgggcttgcgacggtgggaagaggataaggacttgttcagttcctcgtctgacaacggtatgggattctttcgggcggtttccagccacttgtccagttcgtcacggtaaaggcaatagcgtttgccgggcttggtggcagggattgtcccttctgacagtttcatgtagagcgtacccttagggatacctaaatactctgctgcctcgtccacagacatgggcacgtgggtgtccaccgttttggcattgttcacactgcgctgctcggcgagcaggcttttcaggctcatcacttcgtctcgaagctgagcgacaacctcggggaggtcgttgaaggtaagaattgatttttccattcgcgtactcgtctcttttgtaagacttggcgcaaaggactgaaatgatatatccgtgaatatctccacgacacgtcattgcaaaataattcccgaataattaagcccagccataaatgacgggtaaaattactcgggaaacgatgtaaaacaggcggttatgagttaccggatggttgtcgttggtgtcgtgattatcctaattccgcacataatcctcgggatagtggaaatcaagtttgccgttttcgggttcatcaatgggaatttccgtctttaacggctctaccttgaaattcttgatggttgataagtctgtatcagcaaacgatttcgggaaaagggctttgatgaacttggcacggttatccccattgtagtatctcttgtacaggaaacgctcagagatattccatacgaagtgacggagtggaatgttgttgatgtctttggtaaacggtctttgtatgggcttcggggtataagtgttaagattcatccatttgtccacctcagtacagatgtggttcacggtttcttggtcggcaatgcgaggcaggtaataatggcaatactccatgaccatgcggatgcgctcttccttttcccgttgctctctgcttgcgtaattggcacggttcttttcgtgaagatccggggcgatagtaagctctatcggttgtgtttggataagtgtctcttcttttgtcggggatgattcgggtacaggctcagggactgatgtaggtccaggcacagatgtggcttcttcaagtgtattttgtgacagttcttcctgcacctctatggcttcggcaatcgtttctttcttgccgaacttgattttgtagatttcgtatgtatcaaagataagtgtctgaaaggagagatagagcaaccatcccaacaggttacagcatacgaatactatccacctgacaaagttgtcttggttgaagctgtccgctattaccagcgtggcaatggaagatattaggacgatggcgaagccgacaaagcccaagatgatgtatttgtccttgattgatgattccatatttcgttgagagattgaatgttcctgtattattttgtgcaaagttaatgctatttttcccaattactgcccgttatttgcggttagaacggtctttttcaatgtatttcacgaaatgtcatcatatcatactctgtttcatactctgaggggcttataaatggtggcatcaagccaaaaacatagaggggcgattatagccttgtagccataaccgcccctctgaatacctgtcaatgtgagacatttatgcctccttgcgcttcaaggttatcttgtccaccacctgacacatctgctgcgctgctatcttggaatagatttgtgtggtggtaatgttcttatgtccgagataggcttggatgacagccatgtccgttcccatttccacgtgcaggcttccgaagctgtggcgggtacagtgaaaggtgattttcttggttatccctgctgccgtgagccaccgttggagtggtccttgcagcatcttgtccttgaaatcctcaaagataagtccctcgccccgttctcccagcagtccataggcttcatcactgatggggttatgcactatttctttggttttctgcatacgggtggtaacgaacatcctgccgttggtgtatggttgtatctgctgccacgtgagctgtctgatgtcgctctttctcagtcccgtaagacaggcgaaaagaaaagcttttttcaagacctcctcctcacagggtgtttcggcaagccgtatcagttcctcttggctcaaatgctccctgatggtgggaatgcactcgatgcggtctaagaagccgtttgggttctcctttatcttcctgtcacggtaagcggtgtgcagcacggcacggaaagttgaccaatagcctgctgcggagttgatgtgcagcttttggttggtgtggatggattggggtgcatcaagcaggtattccatgaacttgcggcacaaatccacatccacctcctcaaaggtgcatttgccgttcacgaaccgctggaaatgcttgtatacgtgctgccacttgatattcttgcggtcagccagtcctttgaaataggcaaggaaatcgcccttcatcttggtcttgtcaaaaaagccgttgttttcattgaaaatggcttcgtagcgctggttgcgcaggatgaccgctttcttcatcatgcgtgcgttgaagtcccgttcctgctggtttgcaggtttggcgaagatgtaaattcctaaggcttcacgtgtaatcactctcatggtgacattgtcacggtagccgggatagtagtcaaggcatagtgaatactgtgtcccgttcttaatcttgcgcttacgcaaggtaactgttttgcatttactcataataattatgttttaattggttgtatacattttggagttgtatccatgtttccgatggcaaaggaacaacgtgaaatatccgtgaatacctccacgatacatcattttgaaataattttcgataatcccgatttttcacggttatttgttcctttcagccatgacacgctccacatctgagcgcaaaagcaggtttttcacacccacctttatcttttcgatgtgcttcaccttgacgatatggcagatgttggctgacgaaagaccatagatttgctgcacctgctcaacggtatagtagcgttcatcgttcacaaggtcagttctgcggagttcgttcaaatgtgatttggagtaataggtacgcccgtactctcttttagtgggtatcttatggcgataggtgtaggcacggagtgcggtcggcttcatgccgaacagttcctccacctcctcggtcagtagccagtcggtaatttcgctaatatcaactgccacaccgaaaaactcgtcaatatgcttcttgctgtaatagttctttcctgcgatacggcagatggggatatggttacgcttggcggaagtgtaaagccatgactgctttaccttaaaaagggacatcacctcctcgcccgaatagaagtccaacacttcttcgctttccttttcccttttttctcttttggcaggtaaggaagatgaagatgatttccttggtgtggaggtgttgccgggcaggatgcggtgatagggattgccctccaacatctgctcgatgtcggctctgcggatgaatgccatgcggttgctgatgcgtgaggctttcagcttgccgatggctacaagtttgtaaatgtactgtcgggaacagcccatgaggatggctgctttggaaaaggtgagatactcctgatgctgtatctccatcaagggttgggcgactttgaagaggttgttcttctgcatcactctggctcgtttggcttctgcctgacaagcctcactgcaatatctttgcataccgcttcgggttacaaaggacttgccgcaaaaactgcattttctggttgctttcataccgttttatcgtttaatggttcatttcttcaatcctatatctctgaaatggtaaacggatgtgaacggaagtcaaccattgtcgcttttctacacagtgtgactgtttccgcatatcggggcggttattgtcgcttgtcgtaaacggttgtaaacccttgtcaactgtctgcacggtgtgacaaaaaacaagccccgcaaattctccacgtcagaaatacgtctcaaaaatatgtggaaatttgggaagcgacaaatggcaaccgaaaagtgttaaattttagaatatgctggtaattaaagatttacactcggatatttctgattagttttggttgttctatggttataaatacagtaattgttttaatcagttttttatgtggagcgttctttgtaagtgctcaacaaggtaatcaacaacaaaggcaacaagagcggtggaaaccggaaagtacagaatggtatcatcctgtacctccaaaagtaacccctggagttggaacaagtgctccttctgatgcaatcatcctgtttgatggaaaagatcttacaaaatgggaagctgctgggaaggatggtggatctgcaaaatgggctataaaggatggaacgatggttgtagttcccggttctggctctatccgtacaaaagagtattttggtgattgccaattacacatagagtttaagaccccgataccaggtaaagataatactttacaaatgaaaggaaatagtggcattatgttacaaagtcgttatgaggtacaggtcctagattgtgaggataatcctacttacgtaaatggctgggttggtagtgtttataagcaaagtgctcctttagcaaatgcttttacaaagacgaatgaatggcaagtttatgatatatattggaaagctcctcgttttggaacaaatgatgagttggaatctcctgcgatgataacagtcgtcttgaatgggattgttgttcagaataattatgtgctgaaagggaataccccatatacagggttacctaaatatgtagctcatggccgtatgcctttaagtttacaagaccatggggtagaagttgctttccgaaatatttggattagagatttgtagaaagaagtttaaccttaaagaatgataacttatgactacacgtagaaatttcttgaaaaatacaacaatgctggcggcaggtttaggagtatctcctcttttgtcttcgtcacccttacgatcttatcagaaagaagaggtcataaatggaaaagtaagaattgccgtgattggagttggaatgggatgtcgagatttgcaaggagcgttgactgataatccatgggtacattgtgtcggtatgtgtgatgtgaataaagtcagacttgaagagcagcttgcacgttttaagaaagattttccagaacagacggtttctataaaagcttatactgattttcgggaggtactggccaataaagaaattgatggggttattattgccacgcccgaccattggcatccttatatttttgcagaagccttgaaggcgggaaaagctatttatgtagagaaacctgttggtaattcaatttctgagtgcaatgcgatgatggactttcagaaaaagtataaaggtgttgtgacaacgggattatggcaaacaagccaacgctatttcagggctgcgaatgagatattaaaatctggtgtgctaggggatgtttataaggtacaattatggctttgccaatctacaaatcctcgtccttctgttgaggattcagaggcaccatccactttggactatgatatgtggttaggaccggctccggaacgtccttttaataattcccgttttcgtggttggcgtggtttttgggattatggtggtggccaacagactgattggggggtgcattggattgattctgcttttgacgggttaaaagcacttggtttatgtgatagagaatacccagatgcggtcttttctattgcatataaagatccggcatcgtttaatgaaactccaagttgccaaacaagtattttccaatataagaatttccatattgaatgggctcaacaagttgcttacctttataatcggaatcaaggggtcgcttgggtcggaagtaaagccactctggtatgtaatcgtgaaggctatgagttgataccggagaaaacccgtgatggtatccttttggccgataaagctcaattggttggtaaatttgaagatgggggagtagaggctcatgcgactaattggtgtaaatgtattttgaataaatcgattgagacaaatagtccgatagaaaagggggcttttgctacaatattggctcatatggccaatatctcgtatcggacaggaactcgtgtggtatacgatcctcaaacaaggaaatttgtggacaatcctaaagcggatgcatacttgaacaaaacatatagaagcccttggcaatttccgaatataaaatgaatgaaattatgaaaagactattattgtttaccatttgcttgttgtgcgccagttctgtatatgctattgatatttcacggttagaacctgcttgctggtgggtagggatgaaaaatccggaattacagattatggtatatggcaagaatatcgcaagctctcaagtttatattgattatccgggggtaagagtcaaggaaattgttggagtcgagaaccctaattacttgttcctttatttggatatctccagagatgcctctcccggtacaatgaatttgatatttcaaaaagggaaagagaaagaaatccgggcctttgagttaaaggaaagaaataaaaaggttggagctgctggattttcacctgcggatgtgatgtacttgattactccagatcgttttgcaaatgcggatccatctaatgacaatctagatgatgtgaaaatagatcgttcgagagggggagctcgccatggaggtgatttacgtggtattattaataaattggattatatccgtgatttaggctttacgacaatttggttaaatcctgtattggaaaataggatgccgggaggttcttatcacggatacgctattactgatttttatcaggtagatcctcgttttggaacgaatgaagaatattgtgaattgatagataaggcccacgaaaaaggaatgaaagtcgtgatggatatgatttttaatcattgcggaagctctcattggtggttaaaagattttccttcctcggattggctgaataatcaagacaactttgttcaaacaaatcattttaaatggactcttatggatgttcacgctcctcagtcggagagagagatcttggtaaatggttggtttggtagaggtatgccagatttaaatcagaaaaataggcacttagcccgatatttgattcaaaatagcatttggtggattgaatactcacggattgatggtatccgtcaagatacacatccatatgcagattatgattttatggcaacttggtgtaaggaggtggaaaatgaatatccggatttcaatattgtgggagaagcttggtatccaagagggactgcttcggcttggtggcaaagagattctaaaatgaatgaatctaatagtaacttaaagacagtgatggattttgatttgacctttacttgccaaaaagcgtttggagatgcatgttctagccgtgaaggattcgaagcagggttatttaaaatttatgaagttatcgcacaggattttttattcccagatcctaataatgtactagtctttttggataatcatgatttaggacgctttatgcagaaaggagaatctgatttaagaaggtataaacaggctattgcttttttattaacaactcgagggattcctcagatttattatgggacagagattttaatgtctgggacaaaagcagaaggagatggtattatccgcactgattttcccggaggttgggcaggagatccaaaagatgctttcactcctgagggacgtacggatttgcagaatcaagcttgggattatatgagaaaattattgaattggagacagcgatgtgatgctgttaaagaaggtaagttgattcattatactcctgataaatcgggttgttacgtatatgctagggtaaaggataataaaacggtacttgttttaatgaatggaacagatcaaaaccagacattagatatgaatcgttttcatgaagtcgtaaaagattatagatctgggaaagatattataacagatacgatcgttgcgatagacacggcggttcatattccggctcgtggtgtttatattttagaacttgtctaactttaaatttaatatgtcatgagatgtaaaagtattagtgaatttattatgtgctttatgctttctttgttttcattgacagcgtttgcgcaaatcaagatcacaggaactgcttctgatgcggagacaggagagcctttatcttttatcaccatacagattaaaggtaccactgcgggtactacttccgatatggatggaaattattcaattgaggtacctaatagagatgccattttagtgtattcttatattggttatcgttcccaagagataaaggtcggaaatcagactcatattaatgttcgtctatcggaagatgtggagacattagatgaagtggtcgttgttggctatggagttcagaataagagagatgtgacaggatcgatcgctaaagttggaagtgaggaactaatgtctgttccaacaagctctttcgatgccgctttacaagggcgtgccgctggtgtacaagtaacccaaacatcgggtttggctggctctggtgcagccattcgagtgagaggtatcgcttctattaccgctggaggtgatccattgattgttgttgatggaatacccatcatgcaaaatgccggagatcgagtgggtgcagcacaagataatccaatgtcatctataaatgcgaatgatattgaaagtattgatatattgaaagatgcctcggcaacggctatttatggatccagaggtgcgaacggtgttgtcttaataacaactaaacgtggtaaatcaggaaaacctcaaataaattttagttctaaagttgcattttcaacaactaataggaaagttgatatgttggaaactaaagattatctggatatttataaagaagcattggaaaatgattataagtttaatccctctggtgcgacatatccttctactgtatcatcatatcccggtggttattcagaagaacaagctttattaaataatacggattggcaagatcttattacgagaacaggaatttctacctacaatgatttatcggtatcgtggggtaataagaaaatacagacttatttaggggtttctaatgtagaatataattcatatttggtgaatgatcatttcggaaggacgagcgtacgccttaatattgattataagcctataaacattttaaaaataggtggaaattttagtttctctcacacggatcatcgacccactccttcaagttgggatggtggttggggacgtgccataagtacggctttgccttatttcccagcctataattcggatggtagttattatgtttttcctaaatcaacaaatccggtgacggaggcaaatgagaaaagacgtagaatatttacccaacgtacaatggcaagtttatatgctgacttacagataatcaaaggattgtcattgcggctagaaggtaatatagattatcgagataatgagtctaattatttacgaacgaaagaattatcaacaaaaccgaatagtaatgtgacaaatcgttatgagacaaattggaatgcgaaagcactcttgaattatagcttgtcgattaatgaaaaacatcgttttcatttcttgttgggaacagaagcattgaaatctacacgagtatcgaattatacgaatgtcgtatttgagcaaggaaaagaagattggttatttaataatccggcttatgatgaaacgaataagacttttacgagctatcctaatcaagatttctcatttatatcctttttcggacgtataaattatacatttaaagaccgttatatgttcactggtactttccgtagagatggttcgtcacgatttggggagaataataaatttggtaatttccctgcggcttctattggttggatgatcacggaagaggactttttaaaagataacgaggttgtaagcttgttgaaattgaaaacaggttttggtattactggtaatgcggaaatccctaactatgcgcaatggggggcagttagcgtgaatacgaatcaattgtatgtaggggataattattggtatatcaattctttgaaaaacccagatttgaagtgggaaacaacctctacttttgatgtaggtttggagtatggtttcttaaaaaatcggatttcaggtgaaatcggattttataataagaattccaaagatctatttttgaatgtaagtgttccagcatctgtgggatatacggcattcttggcaaatatcggaaaagtcagaaatacgggtgtggagtttaatattaaatccgtgaatattacaaatagagattttacatggactactgattttaatatcagctataataagaataaggttttggatgttggtaatgcaggaccagacgcattaagtggagaaggtgatacacgtgtgttagtaggacagcctattggcgtaaactatttggttaaggttctacgtgttgatcctcaggatggtatgcctgtttatgaaatgcttgatgagaataagaaaccggttggtgaaactaaagaatataatgcggatagagatcgtcagcctgtaggccatccttattccgattttgtaggaggtttgaataatacgtttacatataagaactgggatttcggttttatgtttacattccaaataggcggcaatatttatgacgatggtgagaaatttcagatgaataatgttggcacttggaatctgaaaagtaatgttcttgatagatggcagaaacctggtgatgtgacagatgtacctcgggtaagtttaggaaaaagtggcattgaactggcgagaaatacaactgaatatctacatgatgcgggattcttacgtttaaaaaatgtaaatgtgggttatactttcaaaggtattagaatcaagaagtttaatataagggatattcgattatatgctcaagcaactaatttattgactttatttagtgaatactataataaatatagtggtgagcctgagattatgcgtgatgtcgattcagctcagaagaggaatttgagtttgaatgtgacttatttaacacctcctcaagctcgtacatatactatcggattaagtgttaacttttaaatgaataagattatgaaagtaaaatatatagcagtaatattactcagtacccaattagtctatacggcatgtgatgacatgggatttctacaaataaaaccagatagtttagaactgacagatgatcgtattaagacggtagatgatttggagaatttattgttgggtgcttataatggaatacgttcttcgggcttttggggaggccggacgttgcgtggttttgatgtgatcgcagatgatggtgtggcagatgtggctacttttgaatgggttcagatgagtgctcatacaatgaatttggtaaatgcggttggacgtgatacctggaccgcgacatataatgccataaatatggcgaatcaagttgcgtttagcgatttaggggaaagtatcttggcgagtgatcctcagaaagaagctcaatttaaggctgaggcatcttttattcgtgcattaggatattttcatttagtaagagcctttggccttccttatgcagaggagactaaggatatcgcagagatgggagttccccttcgtttaaggggggtgatggatcgtgctactgcatttgaggtcgtacaacgttcaacggtctctgaggtttattctcaaataatctcagatttggaatatgcgatcgaaaacttacctggagagaataaagtagagtctggtagagcgaccgttgatggcgcaaaagcgttattggcaaaagtctatttttataaacatgattttgggaatgcggctaaatatgcggaacaagttattaatactcagaagtatgatcttgatgaggatttgactgctaaattcggtagagcggaaaaaaagactgttacgcaagaaattgtagcgatgataccttctgcgtcattgattgaggattcttggggtggtttaagagattatcgtacgaatggattggctttacccacaagcaggccgtctaatgagttgattgctgcttatgaccaacaaaatgataatcgttttaaaacgttttttaaaaatatagacggttcatggtatactctgaagtttgattatgagtatatggatggtattattattggatataatgagttgttactactttatgccgagtctttagctaaatcgaatggaaatatgaatcaagctttgaatgctttgcaaaaaatagaaaaaagggcttatggcaaagctaatactacaactactgatagggcttcttttattaaagcagtacagaaggaacgtcgtttggaaatagctttacaaggtgagagattatttgaattgaagcgtatcaaacagtcggttcgtggtgaagcttgggattctcataaagtgatgtttcagattccggatgttgagcagaatggtaatcctgatgttaatatgaattaacttggctgtttaaaaagggtgagtttggctcaccctttatttgcttttacatctaaataattatagctatgattagaaaaataataatatttacttcatttctgttatttgtacttgggacagtggctgctcaaacgataaataaggtagagccgttgttttggtgggcaggaatgagaaatccagaattacagttgatggtatatggggatcatatttctgaatatcatcctgttataaatgaacctggtgtttatttaaaaagttgtgtaacggtagatagtcccaattatttaatattatatttagatttatcacaagctcattctggaacatttgatataacttttgtgaatggggaaaagaagttcgtatatgcttacgagctgaaagagcgcaaggagagtacagatgatatacaaggatatgattcttcggatgtgttgtatttaattatgccggaccgttttgctaatggtgaccaatcgaatgatcagatttctatgtcaacggaatatgtgatggatcgtagtaagcctggggctcgacatggaggtgatttgaaggggatcgaagatcatttggattattttgtggaccttggggtaacagctatatggttaaatcccgtgttggagaatgatgggaaaggaggttcttatcatggctatttctcaacggatatgtttcatgtggataggcgtctaggatcaaatgaagattaccttcgattgataaataaagcgcatcaaaagggattacgggttgttatggatatgatttttaatcatattggagcaaatcatccttgggtgctagatgtgccatctaaggattggtttaatgtaagtccttctaaaagggggaatcatgctaaggctattttctatgacaattatgcatcaacttatgattctgaagtaatgaaatatgcaggatttggaatagatttgaatcaagcaaatcctcatgttggtaaatatcttattcagaattctatatggtggattgagtatgctcggattgatgcgattaggcaagatacatatccatattccgattttgatatgatgcgtgagtggaatatccaaatcatgaatgaatatcctcagtttaatatagttggtgagatttggactaattatacgattggtacggcttggtggcaaaaagggtgtaaacttaattttggaaaagatacggaactgaagtctgtgatggattttactctgatgagtattgcaagtgatatctttaatgacaagtcttcaccggaagggcgattagataaaatctatgatcatttgtgttatgatttcgtgtatccagatattaaaaatgttttgcgttttttagataatcacgatactgataggtttttacgttcggagcctaaagacttagatggttataaacaaggggttgcctttttattaacaatccctggcactcctcaattatattatggacatgaattgttaatgtctgggacgaaaagtcgcccgggtggggatgggaatatacgtttagatgttccaggagggtggcctggagattctcagaattggtttacgagggaaggacgttccgacctacagaataaggcttgggattatttacagactttattgaagtggaggaagggcaataagatcatttctgaaggtaatatgaaacattatatgccacaattaggagtgtatgtatatgagcgttatctagagggtaaaagtgtcatggtcattattaatggagctaatcatgaagttgatcttccacttgcccgttataaggaatctttaaaagagggaatagaaggaaaggatataataacgaaacgaacgatcttatttaaggacagcttgaagctggcatctaaagaggtattggtcgttgagatgaattaagagattatgaaaataaacagacgacaattcgtaagaaacttaggattgggcacagcctcgttgagtatgggaagtttgatatcgacttcttcttgtgccccttctggggattcccgtgataaaagagggaaagtgagtgatgacgatcaattcctatttatcggtgacgatatcgccatcgcccagacagagtatgggaaggtgcagggatatctgctgaatcatgtatatacgttcttgggagttccttatggggctgatacgtcgggaaaaaatcgctttatgcctccccaaaagccagagccgtggacagatgtgagaccggcggttttttatgggaatacggcgccgcaacgtatggagaaccggtggcccaataattacggaacttttgccgatcattggaactactgggatgtgagtgaggattgcttatatttaaatgtatggacaccgggcattgcggatggtaagaaacgtcccgtattggtgtggctgcatggcggtggttttacaaatggtagtgggatcgagcaggatggatatcatggagagaatataagccgggaaggagatatcgtattctgttccattaatcatcggttggggccgattggcttctctgacttatctggtgttggtggagaagcgtataaggattccggaaacgtggggatgttagatattattgccgccttgcgatgggttcatgataatatcgccaatttcggtggagatcccgggaacgtaacggttatgggacaatccggaggaggttctaaggtctgtacagtagccgctatgccggcggcaaaaggtttgatccatagagccgtggctttaagtggatctacggtaggagcttccgatcaggtgatgacccggaaggtgggagaatatattttgagagaagcggggctgactgcttcccaactggataaattgcaaagaataccttggcgggaatatttggatatagcggatagggcttgtaaaaagtgctgggaagatcaagggattagcatgagacggacttttggccctgttgctgatgaccggaatattccggccggtgtattctactccggtgagagccatttggagtctcctgtcgtcccgatgatattctgtacgactttccatgaatggaacccgaacagggcggatgcggccttggaaaaaatcactcaagacggtgtgatcgagaaactgagaagtcaatatggtgataaagcggaatcgatcgtgaaggctttcgccaagaatttcccggataagactccgatggagctttgggcgatgattttgtcttcccgtcaacgagtggttgaggcggctaacgcaaaattaaagcaaggccagcctgtgtatgtagcttggtttggctggtgtccgcccttgtttaataaccgtatgcgtgcgttccattgctcggatatctgtttctggtttaaaaatacggatcggatgtttactcatacgggtggaggtaaggtacctcgtgcgttgtcagataagatgtctggcgctttgttgaatttcatgcggacaggagatccgaacggaggagagttacccgtttggccgaaatacacggaagaaaatggagaggtgatgatcttgaataatacgtgtgaggctcggaatgatccggaccgggaggcccgtaaatctttggaggtttaatttaaaacgagagtgttatgcttgagaaaaagatttcaagacgtaatatgcttcggactaccggtctggcggttttgggcagtacgttcgcaggcttggcttcttgcgctccgaagaaaaaagaggagccatcacccgaagcatcctcttcgaaacgtcctttccgtgtctgtctcaatgtctctacgatagcgggttataaacttcctgttcaaaaacagattgacttatgtgccgaggctggttttgagggaattgagttatggacccgtgatgtggatgcgttcgtaaagcaagggggaacttatgagacactcaggcgtcagctggaaggttccggacttttattggagaatatgatcggttttgcctcgtggtttgccgatgatccttcgaaacggaaggaagggctaaaccaaatgcggcatgatatggagatggtagcgggattgggcggtaaatttatcgccgctcctgctcaaggagttactcaactggatcgtacacggttgccggagtattccgaacgctatcgggcgatactggatttaggggatgagatgggtgtcactccgatattggaactatggggagccggggttctgaatcaattatcggataccatggcgatagcgatcgcctccgggcattcgcgggcttctgtcttattggatttctaccatttgtacagaggaggaaatagttttgatagtttacgcttgataaatggtaagatccttccggtttttcatatcaacgattatccggagttgcctcctcgtacggagttgagagattcggatcgggtgtttccgggagatggtatttgcccgtttaataaggtacttcctttgctatacgattccggtttccggggtgggttatccgtagagctttttaataagggatattgggaaaccatggatgtaaaggaggtcttaaagaagagttttgagaaaaccacacaggtaatcaatagttcgatgggataaaagtttgttgggatttaggaaagggactgcttcgaggtgttttaccttcgaggcggtcccttctgtttttatagtatcttctcttaaaaatcaattattttataatccgctgtgatataaaatgtagtatatttgcgtactctgttttggggtacgcaaaagctttgttcaccagaatgaataggcattatcctaaataaaccgttgttttgcggagaggtctaggggttgttatcatcgggaaagccgataataaaagatatacattataatgaacttacttctgagatatgtgggtcatggtataactataagtttgttagtatttataatgctggcgtttcatttgtctgcgttagcacggacaagtgaaaaacgtgtgctccgggttgcctttccgcaggtggtaggcatgagttggacggcggaggacggtagtcgtcatggtatgctcgtagactatctcaatgagattgccaaatataccggttgggaatacgagtatattgatacgaacgggcaagccatgttaaatgaatttatcgcaggtcagtatgaattgatgggtggaaactattatatacccggtttagagaaatattatgcttatccggattataatatgggatatagctgttccttgttgcttgctcgttctgatgatcgtactatccatagttatgatttggagagtatgaacgggaaaaccataggtgtatatgagaatgctaaagaaaatattcgccgcctcaaggagtttttggctatcaatggattagactgtaaattacgatattacagcttgaaagatatacagaagaacgacggggaattatatttttatttaatgaatggagagatagacttgctgttgagtggcattattcacaatcacgattctttacgggtaatcgttacctataattctcaaccctattatatcgtaaccaatccgggtaataaggaagtattggatggtttgaatatggctttggaacggatattggatgctaatccaaattttgcggcagagcgttatgccgctaactttcctgcccgacttgtaaatgtccaatttagtgaccgggacttggaatatgtcaagaaaaggaaaacgatcacggtagccgttccggagaattggtatcccttttattgtaaagaaacctcccagaagaaccatgtcggtatcatggtggatatattggataagatcaaggactttaccggtttggatttttcgtatgtgtatgcgaagaattatagtgatgcggtccatctggtacaacgagggaaagctgatatcttaggctttttcttgggagatgagaacgatgcggcccagctagggcttgcgctttcagcctcttatgtgagtgcgaacaatatcatagtacgcaataaagcctgtagttatcccgctccgggtttggttggtgctttggtggaaagtcagcgatttccaagtggcatatctgcggagaagattcggtcctatccgggcattaaggaggcattagccgctgtcaatagcggagaggctgattttatctatggattgtcctctaaaatggaacaggatatttcgcgttatcatttcaccaatcttgctcctgtgacattggtcaatgatcagagtgcgataagttttgcgttacctaccccagttgacccggatttattaaccgtactcaacaaggcgatcaataatctttctgagtccgagaggactgttatacgcaatcggaatctggaatctatcggcgtgaatgaattctctcttacggactttatatatgcgaatcccttacaatttatgtttatcgtgatgtttgtcctgtcggtgctatttacggcattactgctggctataggggcccggatgaaagcgaccgtgatacagggcaacctgaaacgggctgaggcggctaacttggcgaagagcgagtttctttcccggatgagtcatgagatccgtacgccgatgaacggaattgtaggtatgagtactatcgccatgcaaaacatagataataccgataagataaaggattgcctagagaaagtaatcatgtcttccaagcatcttctcgctctcattaacgacgtgctggatatgtcgaagatagaaagcggaaaagtggaacttcgacatgagagctttaatttccgggcattcttgcaggaccttgaaaatctgtatggcgagcaggccaagagtaaagggatcagctatgagacgatattggctagtgatctggaagtacagattataggagactccttgcgcttgaatcaagttctctccaacctgttatcgaatgcgctgaaatttacgccggccaagggaatgattaaacttcgggtatctaaaacaggtgaggatcaagagaatgtttaccttcgtttcgaggtaatcgatacgggatgtggtatagccgaggagaattatgataaaatcttcgaatcgttcgaacaggaaaatgtggatgttacttataaatatggaggtacaggattagggctttctatcgttaagcgtttcacagggttgatgggtggtggcatacatgtgacgagcgtgcaggggagtggcagtacattcaccgttgatctgcctttcggcaaaataaaggaatcgggtaagcccactcgtttttccgatattaatgggaggaatgaccttgcgaaggattgttatgctgttgattatgacttcaaaggtaaacggatcttattggttgaggacaatgagcttaaccgggagatagcggaggaattgatcggagttaccggtgcgtcggtggagagtgctgaggacggagtacaggccgtagagatgtttaaggagtctgccgaagggtattatgatttgatattgatggatgtgcagatgccgcatatggatggctatgaggctacccgatgtattcgtgcattagggcgttctgatgctcaaaaggttcctatcttcgctatgacagccaacgcattcgctgaggatgtgcagaaaagtagggaggccggtatgaacgctcatatatctaaaccattaaatatacgtgccgtgtataagcaaatgaaccggtaccttcaaggataaataaaagattgataaataataaaaaggggctgcctctggaaattaaactttcgaggcggtcccttctgcttttattagatattctttatttttccgtaattaccgagaattcaccgatacccgcttgctttttattatctacgatacgggttgcgaccaaacggatttggttacctttcgttatcgggaaatgtacgacttgctcgatcgggttagccttgatattggagaattcgccttcggccaccttctttccattaatatataattgatagttggagatatgaccgcttgcgtcacgtccttggttcggggtgtagcggaatccggatataggcatttctttcgctaattgtacgactaactcttgtttcccttgtggtaaatagtaggtcgtgtagccgtttccgtctaggattaggctggttttctcatctttcggtgatacgatcgtgtaatcacaagcaggaatatcgaacgtttgcgcggaaaccggactgactgtatcgaaagtcggatcataggcaatcgccttgacagttcctttttgagcgaaagcgaatggcgcctgataaagcggtgagtccttggtcggatctgaaccgtcggtggtataatgaacctcggagcctttatccccggcctgtatggttacctcgtcattgatattacgggcaatcgttggctcggtcaccaaggcgggggcaaggtatgcttccacgttattgatacaaagcggcccgcgggcgtccgtgaagttgatgcgtatcttctccgctttctcggtctggaaacggacaattcgtttatagccgacagttgtcgtagaatccacagtctgtgccggaatccatttacccccttgctcgagttcgatattgaacgagcgtactcgttgtcctaatgggatatattcttgtattaccaagcggtttacatcggtaggatgggttaacgtgaaagtcaatgaaccactggttactccatcgtccgtagcccaataggtatcccaatccccatctactgccttattgggactaaaattacgtcctcttttattgctcgcttgtacgtaacatcctttcaaaagattctccttaaagtcattttggatggtttgataccattgtacggcacgggcggagtctaccggacttatttttccgttcaacgctacggggaagttcaataggaaattggcgttatgcccgacgcttcggtaataaagatcgactaattttgccagagatttgacttggtgatcttcccgggagtgatagaaccatcccggacggatagatacatcgcattccccacctagccacatcggtccgttctcatctccccatacactctgttggaaagtaggcatggagggttccggggcgaagatgctccattgggtatcaccggcccaaccttcctcgttaccgatccagcggatatcgggtactgtccctccgaaaaccatgatgtccgggtggtgcgccttgatcgtgtctcgtgcccgctcatattgataataggtcttggcgtctatagcacgggtttcattcgtgccgccataccagccattgccaccgtttgccccatcaaaccagtattcgaacaacgggccatagttggagactaattcatgtaattgggcatggaatttctctacatatcccggttgtccgtagttctcactgtttctgtcccaaggggagagatagacaccgaatttcagcccgtgtttcttacaagcgtcggatagttcttttaccatatcccctttgccatctttccaaggagaattctttacgctatattcggttgtggcggtaggccatagacagaaaccatcgtgatgcttggtggttaagattacgcctttcaatccggcggctttgattgtttgcgcccattgatcgcaatccagatccgttggattgaatgtggaggcgggagtatttccgtaaccccattccagatcattgaacgtatttaatccgaaatggacaaaggcgtatgtttccatcttatgccattcaacttgtgccggcgtgggaacgggcaggataggggcgggcgctgtcgcttctttacaggagaagaaggaaaacaacccaagccccaataaaatagaggaactcaagtgcttcattatttgtttatatttagatgagacctcaaatatatgaaaaaaaacggcagatttttattctgtctttagatatctagataaaagataaagtcccctgtcttttagatgtctcctctggggaaattttcatgctagcatatgattgtttatcaattgtttgcagtgccagtttatttatcgcctttggcacggtcgtgccatcacagtggcaacgctgtgccatccgtgtggcagggccgtgccatcgtagtggcacagtattgccgctatgatggcaagggtaccggctatatcgtttacgtgagtagtcggtatttttgcgtgtgctatattataatgtacccgatatccgttgccgtaaaaaacttgaaaaataatgcccgataaatttggaccgtatgttttatagcattacttttgcacccgctttcgagagagaacggcgcttcagaaatgatggaaacgtggaggtatccttgggtaggggatgaggttggctgggccaagcgataatttccaaccgcccggagatcggcttgagaaaaaaacttgaaaatttttcaccgaaaaatttggaggttaagaaaaagtccttacctttgcagccgcaatcgagaaacgatagcgacaagagttctttgagagatttacataattcaacaagtagtacaagtataggaaaattaattttccggattgataccgtcaaagaagtatgactttggactacaataacggattccggagcgaggatataaaaacaatttaaacaacgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcagggatcccgcatgggaatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcatagatatcacgcagaaccccgattgcgaaggcagcctgccaagccattactgacgctgatgcacgaaagcgtggggatcaaacaggattagataccctggtagtccacgcagtaaacgatgatcactagctgtttgcgatacactgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggtgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctcctttctggagcttcaggattccgtaccgaggtcatacgaggtattgatcccttgtgctgctgttgagattatgtttatatatagatcttacagaccgggaggccggtcggagagaaaaagatgacgctgggacgtaagtcttggcaaagttgacagtcctatagctcagttggttagagcgctacactgataatgtagaggtcggcagttcaactctgcctgggactactccgaatgagggggattagctcagctggctagagcatctgccttgcacgcagagggtcaacggttcgaatccgttattctccacagtttattgagagggataggcatcagccaatcccgtcccgacgacagtcgggctcagtaagaaggatctttgacatgttggacatcaaaaagaagaaacaagtagagcgagcttaagatatatcaacccgtgcgtcaagtacgaggtgggagaaagtaagcaagggcagacggtggatgccttggctctcggaggcgacgaaggacgtgataagctgcgaaaagcccgggggaggcgcaaatagcccttgatcccgggatatccgaatggggcaacccggcaggctgaaggcctgccatcccgtaagggaggcgaacgtggggaactgaaacatctaagtacccataggaggagaaaataaacaatgattccgtaagtagtggcgagcgaacacggaagagcccaaacccatgtcgtctaggcgacacgggggttgtaggaccacgacgtggcaagatagagtcaagtggaacgccttggaaaaggcggtcatagagggtgaaaaccccgtacacgactgacgattgaagcctagtggcatcctgagtagcgcggggcacgagaaatcttgcgtgaaacagcggggcccatcccgtaaggctaaatactcccgagagaccgatagcgaaccagtaccgtgagggaaaggtgaaaagaaccccgagcaggggagtgaaatagaccctgaacccgtctgcctacaagcggtcggagcgtcgtaatgacgtgacggcgtgccttttgcataatgaacctacgagttaccttccccggcaaggttaagtacctaaggtacggagccgaagcgaaagcgagtctgaacagggcgccaagtcggggggggtagacgcgaaaccgagtgatctacccttggccaggttgaaggttgggtaacaccaactggaggaccggatgggtaagcgttgaaaagctttccaatgagctgagggtaggggtgaaaggctaatcaaactcggagatagctcgtactccccgaaatgcatttaggtgcagcctctttatagtatatcgtgaggtagagcgactgattggatgcgagggcttcaccgcctatcaagtccagataaactccgaatgcgcgatatatatttacagggagtgagggcgcgggtgctaaggtccgtgtccgagaggagaagaatccagaccaccggctaaggcccccaaatgatcgttaagttgaactaacgaggtcggatcgcagagacagctaggatgttggcttggaagcagccattcatttaaagagtgcgtaacagctcactagtcgagcgatctggcgtggataataatcgggcataaacgatctgccgaagccgtggatgtcgcaagacatggtaggggagcattccatgcggcgtcgaagatgagggatgacccttgttggagcgcatggaaaagcaaatgtaggtatgagtaacgataaggggggcgagaaacccccccgccgaaagaccaaggtttcctgatcaacgctaatcggatcagggtgagtcgggacctaaggcaaagccgaacggcgccgccgatggaagaatgggttaatattcccatactgcctcatggagtgacgtggagacggagaagtgacagtcctgccggctgacggaatagccggttgaagggtgtaggtgtcgatcgcggtaggcaaatccgccgcgagagccgaacctgacagtatacggagcgcttgcgcaacgtaatatggacgtaaccatgctcccaagaaaatccgctaaacttatccatgcggcacccgtaccgtaaacggacacacgtggtcgggttgagaatactgaggcgctcgagtgattcacggttaaggaactaggcaaattgaccctgtaacttcgggataaagggtcctcgtcgtaaggcgaggcgcagagaataggtccaggcaactgtttaacaaaaacacatggctgtgctaaatggaaacatgatgtatacagcctgacacctgcccggtgccggaaggttaagaggagatgtcatccgcgaggagaagcgttgaattgaagccccggtaaacggcggccgtaactataacggtcctaaggtagcgaaattccttgtcgggtaagttccgacctgcacgaatggtgtaatgatctggacactgtctcaaccgtgagctcggtgaaattgtagtatcggtgaagatgccgattacccgcgatgggacgaaaagaccccgtgaacctttactatagctttacattgagtttgggcagacgatgtgtaggataggccggaggcattgaagcaggtacgccagtatttgtggagccgacgttgaaatacggcccttcggttgtttgagttctaactcctagttaggaggacactgtatggtgggtagtttgactggggtggtcgcctccaaaagcgtaacggaggcttctaaaggtgccctcagaccgattggtaaccggtcgcagagtgtaatggcataagggcgcttgactgggagacatacaagtcgatcaggtaggaaactagagcatagtgatccggtggttccgcatggaagggccatcgctcaaaggataaaaggtactccggggataacaggctgatcattcccaagagctcatatcgacggaatggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcaggagatttgcgaggctctgacactagtacgagaggaccgtgtcggacgtaccactggtttaccggttgtcccgccaggggcaccgccgggtatctaagtacggatcggataagtgctgaaagcatctaagtacgaagccggcctcaagattagatctccctcaagggtggttatagacgatgaccttgataggccacaggtgtaagggcggcgacgtccgagccgagtggtactaatagcccgggactttcctcacagtgaaggttgatatattttaagacgataaggcgaagctggtctcttcggattgatgtccggtcaaaatcttgataatgatattaaggtggctatagcacgagggatccacctcttcccattccgaacagagaagttaagcctcgtcacgccgatggtactgcgtaacagtggaagagtaggtagccgccgtcttaggtgaaaggagtcagtcgaaagattggctcctttttttggtatatacactagccgtttaattttcaatgatgtctgcctcttattgctagcttccatttacaacagtcatttagatgtaacatgacatgtctggtaggaggcattaataaaataccagctatatcttttttagcccagaaatcaagcaaccaaatcgaatcttcatgatttgtgataccaccttcttctaatatccggcttatcctttgagttgggattttgcgacgtatatcatcgggagataaggttcggatgatttctctgctttttcgtcctacttcattcctgtattctaagagttcttgaatacgtagacttttgcttagctgaataatctggttatcagataaggcatttcctgtgtctctgataggggaattcattcgggtttgccagtcttcattgaagatctgcttttccccgttaactaatatattcatggtcagatcctcaattctgctgatatgccataatacccaagcgatggtttcatctttcgctgtaggcataatggcatattcatcctctcttaaatctccgactagctcatcgacctcgtttctctcattaccagacaccacagagaggtgtaattttccatgaatctcaagaaagagctccttggtttgctctattaattccggtttacggataatgcggtttagttctttatgtgattcgcttaatccggctccaaagtatttcattttggggattattggtagcgtacggctgtcccggcggcggtaaccatcagcatgcttccgcttcctcctacggtctcataatctagatctacggcgattacagcgtttgcgcccattcgtgccgcatgatcgctcatttctttcaaggccgtttctttcgcttcgcgtaagacactctcgtaagaacctgcacgtcctccgacaatatcccggatgcctgcgaagaaatctttgaatacattcgctccgatgatcgtttcaccggatacgattccgaagtactgggtaatttcttttccttcgatcgtgttagttgttgtgagtaacatagcttttcaatttaatcgtttgagggcaaatataagataaagggcgaaccagtgtactgattcgccctttgtttttatgtttctttatatgaatttattttaccggttgatcggtcatgataaactcaagcttacctccatttatgatatcggagtggctgatgaaaggagtctctaggactttaccgtttagcttgacttctttaacgtatttattggcgggattattgttggtcgccacgatctcgaaaataccgccttttacgtgcatagaagccttatttaccatcggacggcccaatgtgtaaaccggaatacccggacttacctgatagaaacctagggcgctcatgacataccaagcagacatctgtccgcaatcctcattaccgatgataccatccggttcgttcgtgtagaaattctgcatgatataatctaaatacccttgccctttccatggagaatctgtccagttataaagataggccatatggtggctcggctcgtttccatgagcgtattggccgatcaagccggtaatatctccggaggcttccgccccgtcaatctgggaagaggtggtgaataaggtgtctaaacgtgtttccagctctttcttgccaccgatagcggcgatgaagttatccatatcatgtggtgcgaagaaactccattggaaggcattcccttcggtatagtcgcttttcatatgcgaagaatagcgagggttgaatggagtacggaaagaaccgtcgcccattaccggacgcatcatcttcgtctcgggatctaaatagcgtttgtagtattcggctttcttggcatactcattcgccaactccatgttgcctgccttcttggcgatttgggagatacaccaatcctcgtatgccatctccaatccccacgatacggattcgggaacagagtcggcggggacgaaaccatatttctccttatagtaagggtgcatcgtgatcagatccaactcacgggttcctttgaacttctcggcaagatcctcacggtaaacggaagaacgtgcgccggcttccgcccacgtgctcatatcaccttccgctaaatctttcgctacaagatcggcgaggaccgagacggccggatatcctaccatacaacctgtataactagaggctaaaggccatttgggtaatattccaccttctttataaccttgcacgagtaccttaccccaatctgtcgctaagtccggattaatgattgtcattaacggatgaagcgcacggaacgtattccacaaggagaatacggaataatttacgtaacccggttcggcggtatgcactttcttgtccatgcccagataacgcccgtccacgtcttgataagcgaagggggcgatcatggtatggtagagcgccgtatagaaattgaccatgactttcggatctgcctcgatctggatcaagtttaacgcctcgttccaaatatgcgttgattcctcacgggtcttatcgaaatcccatccgggcaattctgcctcgagattcttctcggcgccttccggatcgactacggataaggctacttttacataaagcggttgtgccttttcagagaatttgtaatggaacttcaaatcttccgccgtattcaggcgcaaaaacaaggagtccttacgtaatttcccgtccatgtattggtatacggtctcgatcggttccgagaaagtaatccgataggacatggagtggaaatgtgcccaaccttgtgtcttcacggtaccttccaccgtggagtcgtttacaagtaaatattggttaccgatcagcttatgtccccagttcggttgaaggatatgccctaagtcaagcaggacacgacgttctttgggattgtcgtatgtatatttatggaaacctacacgatccgtagaagtcaattccacgttgatgccaaagttatccaagcgtacggcataataccccggtgtcgctttctcagtgtctttcttgaaggtagctaccggtttgatggaatctccaccggagaaaggtaataaagctacgtcacccagatcgccgatacccgtaccggaaaggtgcgtgtggctgaatccatagatatggttgtcgtcataatggtaaccgctgctcgcgtcccatcctaagatatgggtatccgggcttagttgtaccatcgcgtacggacgggtagctccggggaatgtgtgtccatggaacccggttccgatgaatgggtttacatacctcacctcgtcttgtagtcgcggcgactccggcgcttgcttgcatcctaccagcaggcaggcaagagcggcctgaaaaaataagatcgttcttttcactgttattattgatttagtttgtaataagcgaattatcaatcatctgtcacaaagataatggctttgggggaatattggaaatttccttttaaaatctgcaacctttttcgggcttggctcgtcttatagataaaaaagtatgggaacaaacgaatttacgacaaagatattgccgctgaagaataaccttttccgggttgttttccggattaccggagacgtggagcagtctgagcagatcgttcaggaagccctgcttaaggtttgggaagaccgggatagctggattgtcattgagaacttaccttcctattgcatgatggtagcgcgtaatctggcattgagggaaacctattccggagataaggaaaggatggagcggtatgcggtaaggtaatctgcttatggatcgtgtatggactatcaacgaataaataagttgctggataaatattgggaatgcgccacatccgtggaggaagaacgggaattacgccggtttttctcctcagcggtgatacctcccgacttattgccctataaggcttggttcgtatctcatgaggccgaggcattgcctcccttggggaaagattttgatgctcgtatattggaacagatctcggaagatcgaaaattaatcactacatttggaacgttatttaaatctattactcatttaattcataagattatgggaacgaacatgaagaaagtctttaccacccttttatgccttttgttttgtatcgcgatctcggcgcaggataaagccgctgatctcagtaagctcgtaggcgattggtccttctctgcccccgacgctccgtatggatatcaagatggcagtttgcagataaagcaagagaacggcaagttgaccgctaaagtgaatatacaaggtagtaccttggagataaacgatatcaaggcgaaaggagatacctataccagttctttttatgtggatggaacgcctgtagatttaactatgacccagaaaggaaataagttagagggaatggccgacgccggaggtatgcagattcccgtgaaattcaagaaaacgaagaagtagccgctttgtggtactgtgagtttctgttaacttcgcggcaaaaactacaaagggatgtttacagtaatcggaatcatgttctgcggcattgccgtcgggtatttctttcgtaaagtagaattgctgcaaaagatcggtaagcctatttcttatacgattcttcttcttttgttcctgctgggaatttcggtaggggctaatgagtctatcgtgaataatcttacgacgttgggcgggcaagccttgttgattgcttcggccggtacgttggggagcgtcttggcggcgtggggagtttatcatttcttttttaaggaaaggagccggggatgaaagggagtttgatcgtcgtgggcttctttgccttggggtgcttgctgggatggagcggttatctgcccggggtcattatcgagaatgatataacggtttatgtactttacctcttgatgtttcaagtagggattagcataggaagcgataagaaactgaaagagattttgtcgagcatacggccgaaactcttattggtgcctctggctactattatcgggacgttgagcttctcggccttgatcagccttgctcttaccaaatggagcgtgttcgattgtttggcggtcggaagcggtttcgcctattattcattatcctccatcttgataacagagctaaaagaaccgacgctgggggctcaattggcggcggagttaggaacgatcgccttgatcgctaatattatccgtgagatattcgccttgctgggcgctccgttgttcgttagatatttcggaaggctatctccgatctgcgcgggaggagctactacgatggatacgacattgccgatcatcacccgttattgcggaaaggatttggtctttgtctctatctttcacgggatcttggtggacttcacggttccgtttttcgtttctttcttctgttcgatgtgagtgaaagaggcttccgagatctcggaaaccaccttgcaaggttgaaaagtcatttccgaggcctcggaaggcattttgcaaggttgaaaagtcgtttccgaggtctcggaaggcattttacaaggttgaaaagtcgtttctgaggcctcggaaggcattttacaaggttgaaaagtcatttctgaggcctcggaaggcattttacaaggttgaaaagtcatttccgaggcctagaaaagctattttacagtttgcagcatcacttctaccgctctttttaattgcgtgtcctcgccggagagctgcgcctcgggagtattgtacacctcgacatccggttgcaattgttggttttccagataattgccttgcatatctttcacgcctacttgcgggataccgaacaccaaggtcggatcgatttgcgtttcccaccatacggctgtcatggttcccggaaccggggcgccgatcagcttgccgatacctaaggtcttataaacccaagggaaaccatgagcgttcgaataattatcctcgcacatcaagacacaggacggtttggtccacttattgtaaggatcgctaccgatgtattgtccgcgaggctcgaagcgctgatactccttgccgctcaataaggtagccagatcatcatgcaaccagccacctccgttatggcgggtatccacgatcacggctttcttattccggcaccggcctaataaagcggaatagacctcacggaaactctcgctgttcatacctctcacatgtacgtacccgatttgcccgttcgataatttatctacggtttcttggcaattctcgatccatcttttataaaggaggttcgattgctctccgttaccgatcgctttcacctgttcctcgaaacgctgtttactggtaggatcatagacagaaagcattactttcttaccgactttaccgcttagcagtggataataatcggcgtctttctttatcggtgttccgtctatcttctcgatgatacagcctttctttatctggctgtcggccaatgtcagcgggcccttggcgatgatttcctcgatcttcaatccgtcgcccgtgtatgcgttatcgaagaaagcgcctaagctggcggtttccggcccggttagtcccggattgtaacgagcgcccgtatgggagccgttcaactcgcccaatagctcggaaagcatctcttggaaatcaaaattgttgttgatatgcggaaggaaacgggcgtaagcggtctcataccctttccaatccatgccccggagtgtcggatcatagaacttatccaagacttgacgccaagcgtggtggaagatataagcacgctcctctgccggacgataagcgaactcggccttgaaagcgatcggtttttccttgctatccttcaactctatctttttcagtttaccgccggcggtaagatagaggttctctactttcttatcggcgaatagagtgcctcgaccgacattcttgagcagtaatttagtggacttttccttcaagtcgtgttcccataaatcaaagcctttctcgaaagcggcgcaataatatagtttatctcctttcggggcgagtacggcgtctcccaatgaggatgaattagcggtcaggcgaataatccggtccttgcggttctccaaatcaaacttcaagggggctacaggcttatccttatcctcttttttcttatcggaatctttatcggatgtcttatcctcgtccttatctttgttttcatccgcttctaccaaggccagttcttctttactgaggcggaatttatcgtaagcctcaccgtcgaagaacatgatgtacacatcccgctcagcaccccagctaccgtggctgcggaaaccggcacggtcggaggaccagatcatggccttaccgtctaatacccatttcgcgtcgccatccgaataaccgctttccgtcaggttcgttacctcgccgctaccgtccgctttcacgagggcgatatccgtattgttccatcctccgacggagatgtaatctaccaagaaccacttgctgtctggcgaccattggaaatgctggtctccatcgctatacgaatagaggtatttcccgtccaatacggtgcggacctgcttggtctttcggttgataacacgtaaggtggtgcggttctcaaggaaagccacctcgttaccatccggagagtataagggttggaacgaggtttgtccggagacgacaagaggctcctctttcaattccggggcgtacgtgaattgcttatcttcgtcacgtgtaagtttactttcgtagattccccatgttccttcccgttcggcggaatataccaatgaacgtccgtcggggctgaaatctatattgcgctcttgttgcggcgtgttcgtgatttgacgagtcgtctcgtattcaatagaagttacgtaaacatcgccacgagtgataaacgctacctcttttccattcggggagacggcgatatccgtagctccatcggtcagaagacgatggattacgtcgttctcgatcttatccgcgacgatctggatattcaccttggcaggtttctggccttccttaacggtatagatctcgccgtcgtaactatagcatagagtcccggtattatcggaggtaaggaaacgcacggggtgggtggtatgcgtcgtgatttgtttctcgctgttgcctgccaaatctttcttgaagatgttaaagcttcctttctcctcgcttaggtaatagaaagacgccccatccgcggcccatacaggattacgatcctcaccgccaaaagtggttactttctggaaagagcgatcttttccaagcgtacataaccagatatcacgggtgatagaagattgatgatgcttgcgccaagggtcctcgtaacctttgtagtcattgtataataatttactgccatctttgctgagggctatattttccatgtataacgaagaatataaatccggccttcctccgtccgtgcttatctcatagacttgcataaagcgggtgccggggaattggatatccttggcgtcttgcaatacgttggctagatacaagatgtgtccgttgtccttaaaggtagtgggatattcgtttgtggagtgggtggtgagccgcttaggttcccctccctccttgttcatgagaaatatatcgaagttgccgctacggttggaggcgaaggctattctctgtccgtcgggcgaccagaccggacgggtatcatgcgccggatgtgttgtcaactgccgggcttttcctccggaagaagggaccgtgtagatatccccttggtaagaaaatgcgatcgtctgcccgtccggggagatcgcgcagtaacgcatccataacggactgtcgtctgcttgcgccgccgccgataaaaataacgccagcgcaggaatcatcaagtttttcatgtgtactctattttagatttacaaatgtaatcgattttcgatatttattaggagaaataattgcgtagattaaatttttaaatatttttgcatatgaactttaaaaccgccaagatgatgactaaatatagggtgtgtatgacttttatgtccattttattattgctatttcattttgtgtttctgttttcttgtggaaagctaccggaaaaaacatttgctttttctgataacctgcggattgactctttggaacatatggctatggattcgatttaccggaatcctcgatatgctcattccgcattggatgaagctttaagtctaactaaagatagcgataaatattataaattacttgcggttaaaagccagatttattttgcaaatagtgtatatgattccgggtttgttttacatcggtcaattatagattattgcgaccgtgtaccgatgtctcccaagatacatggactcttagggacgctgaaaaatacggttggcaattattattcatttttggataaaacggattcggccctcctttgctattccgaggcgtatcaagagatccggcagagtgagatggagcataaaatcccggatatttatatcaatatagcggatatatatgcccggaaaggagcttacgatcagcgagcccgctactttcgccaagctcttttcgtgagtgattcattgggtattatggatcggatgtcctttcctatttattttggtttgggcgagacgtatatggaattgagggactttgacttatccgatcacttttaccgtttggcggagaaagaactggattctcgtaacttgagcgagaaattcaccttttgcaatagccggggaaattactattattacaaggaagaatacgcggaggcgcttccttggttcttgaaagcccgtgaggtggtacgtcctactcatatggatttctataccaacgtatgcgagatcaatttaggggagatctatctatgtatggatcagttggattccgctcgtttttatctggaaaaagggtttaggtacttccatacctataataataagacggccttgtaccatttgacaaccctgaaggcttcgctagccttaaaagaggggaactccgggctggcttatcaattgttgaggagttacacggatacggtaggcatagatcccaagatggtagtgatccgtaataagaacttgcagaattacttcgctaccacgggcgattttaggcgtgcttatgagtatcaaacgaagaatagcgtcattgagaacaatattcgtagcgaacgaacccagatgcgtgtcgccgagatcgatatgcgttataggcaagatacgactttgctcaagcgggaggctattattaaacaacaggccggccggatggaatacttggaaatgagccgttgggtttggatcttgctttttgcgatcttgtcgatcgtcagcggcatggcttattactttatgaaacgtaaacggcatgcccagtggttaagccatatcgatcaggtgacgaagctgaagatggagagtatccgcaaccgtgtatcccctcattttatattcaacgttttgaaccgggaaatcagcacggaagaggagggaagcctccgccgcacgcaactttccgggctggtggagttgttgcggagtagcttggagatctcggaaaagctcagtattacgctgcgggaggagctgaggttcgtgcgtacgtatctgaacctgcaaacgcaagcgctggggccggacttccatttggcatggaatatcgatccttcccttgacacggacgcgatctatctcccggccatgctgatccagattcccgtagagaatgccgtgaaacatggcttgtgtgcgattgagggcgagaagcgattatccgttttcgtggagcgcgacgggaaaggcatccatatccgtatagaggataatggacccgggtatcgtccgtttacgaatgcgggacatacgaacggtacggggatgggaacgaaagtcctttaccgtacgatcctattgttgaataggagaaataaagagaagatcacctattcggtccaaagcaaggagaaggggatggggagcggaacaatcgtcagtttctttattccgttggattttaattacgctttctaggtatcgtgaatgtacgaaagtaatccgggccgtttcctccggatagtggatggaagcggcccggatcgaattgaatcgaatcggttgattcgggttatagtcgctcaatgtcttcaacagaaagtccggagcattgggcgataagttcggagtcaagtccttgctccttcatctttcgggctatctggagtttttcctcttgacggcctttctcgatccctttctgcattcctttttcaatcccttccgtttgtgcgtaatcgatggtcgcataccaatcccgataattctttaggttttcctcgtagatcgcacgttctttttcgctgagtgagttgacgttcgccacgtccagcaagcgaaggaaggtctcctgttcctccttgaagggagattgttcaaataggttcatattcttcaatgtataaatccaacgttcgaaggagctcttgcactcctccttgcttaaactgaataacgggaacgatatgtagatctgcttcatcttgatctcattgaacacctttcccgtcctctcgttagcgaggacaacatctgtacggaagtctgtgaactccggcaacttgaaattcaagaaatagactccgtagatgggtagcaaccgatattgccattgcttgccgatttgtccttgccgggccaccatgcgacaaagataataaaaacctctgttaaagaaatagtgctggggacaattctgcatctctaggatgaacttggccccggacacgtcctcgcagagcaggtcgaatatgatggtacggttctcgacggtctcgggcttgatctccttgtcgaggtaggtgatgtccttgatctgtcgttcgccggctagggcggcgttaaggaacttgatggtaacttgcttgtcttggaagacagccttaaatccagcatcagtcatgatgtctacgtattgtgccatagttaaatggttttaggtgattactgctccaaaggtaaggtttattttcgtatcgcacatcctgtttattgtatatttcttaaaaagcagattcatggtagtcagctttactatttatagaaagtacgattagtattaatagtagtgcaaaatactatggatagtaatcggctcccattttgatcaattcttattatacgctgattatcagaaatataaataacaatctttaaatattaggcttattgtactttttaagagatcaaatttggtatggttgacttattcttttcacgtataaagataacattaaataatagactaagccgctagcataaagttctccaagtgaataactaatcacttctcaactcgtaagcttatggcttgacaagccttggattatacgtttgtagtatttgcaatgattgcatgtgaatgtttgtattttgtatttattatgcggttatggatggataccatatattaatgtacatgcgtacattatataatagatagaaacggctagtctaaacgatcgattcttttagtcatttgcaaaggtacgcgtttcttcgatacttgcaacccttccagacgatttttttatcgcttattctctttcttatcaataggataggttatccttcacgaaacaagcgattccttcaacgaacctcccgtttcgacgctcaaaaaacgcaagatttagacgatcgtttagactagtcgttttcgagaaaaacaagggtgctaaacggcgggatggactttaattaacactattattaatattaaattttgaatttatgaacaagaagttttctactcttttggcaggtatggcactgttaagtgttatgtctgttaatgcacagactacaccaagtcgagtagacccggaaactgtattgggtcaagaatggcgtttaggcggtttgaaggagggagctaattctggtctttatcagttgaaggtcatggatggcactactcctgcttatcttgcgatggagctaaatcgtggaacaggtgattatgaactacgtgtttatagtgcaagcgaagctaaaaataatttagaggctacattgtggtgtgtttctgtctctaattataatcaaggtcaagctcctatttatgacttccagaataaattgtctggaactatgttggatttgacaatggctggccatgagaagactgagaatggtacgaatggtgcttggaaacctgttttaggtggtgagatcgcaggttgggcattctctcgctcatacaaggatttggaagaaaagagacctttgtattcttatttctcaacggactcaattgttggtttgaaagcggatcctactaccggagctgttaaggttgccaagtggggtgctaatcaaatagatgccacttcaaacgccgctgatgtgactaactttgctttggttggcgcagcacaaatcgcattgagcgaagatcaagtaaatacgaagttgggtcttcttcaagataacaaggctggagtacaattgactttcactccggacgtgaaaggtactagcttaaagaatccgttcaatgagcagaagtttatcgcagaggataaagataataacaaatggcttttcatcaagcaaaaggataaagaagcttatttgaaagttgatacggcttatacgaatgagacaggtacaaagttcttagcttacggttggacagagaaagcaaaggataaagctgatgcttacagttctattagctctgaattacgtgctcaacatcagttcaaattcatctattctccgagtggcgatagcttatacatctatgtaaaaaaagttacttggaataatgatggcaagtattggaatacgcacgttacggctactccagttaacgagcatgagttctggcgtgtctctttgcaagacttgattaaagatgaaacttgtattttgacagttgatccggaggaccagaacactcatatttctttgggtcttagcggatgtgaggaaaagggttcttccaagacttccgttgatgatggtgtttatttcatcaagaataaacaaggacagtatttagcttctcctatctatgagaatggtactatccgttggacaaccgtgaatgaggatgagcagagtgttgctcatatgccagcttatcaatgggttgtattgaagaaaaatacaagtaatgataaagtgaaggctgtgtctccggttactatctctaaccgtgaattcgcagataaagttataaatgcggattttgatggtgatggccagatggagtcatataagactgctgtttattctactgttcagttaagaaaggcagagggtggttcttatatgtttgtatatggagataaacttacagcggagtatggctctgtcggtatagattctttgttcttcgagaaagttccggcagcttctatttctgatccgtatttaggttacagaaagttggagaaagattctttgttggttaacaaatatacgtttaactattggcatccttatgctacggataaatacatcgctaaatctacagactctacgttgactgtgttggatggaaaagatgctttcgtaattgatacattgactgagcgttggaaaaataactcaaagatatttgcgactgtagatatcccttacggttataaggttagcgatgatgtggctaagaatcgtattaaaggcttgaagactctagtgagaactgcttatgaggtttcttataaagatggtaaaggtgaacttaatgaatggaaagttaataaggaagataagtttaatgtaggttctagtgctactggtcatcagcaatcttatacgacttattatgcattcttcaaagaaaacaactatatcagtggaaagcactattatgcgattgttaatgctgcatatgataattattctaatgctacaaaatatgtattaggttatcagaaagctggagtatccgattatgacggtgccgctacattgaagaatcaagtattaggcgagactcgtacttctgctttcgctatcgaaccggacaacactccgctttaccgtcgtttcagttctcttgaacttgaaggtaatgaaggtgacaaggccgatactttacgttttatcgagaaataccgtaaagaatacttgcaggttgagaataataagaacttcatgaaagaaggtattgacttcttaggtatttatactccggataagactgaggatggtttgtcattcatcgttgataccgcatgggtaaaccgtggttctggtaatatcaagcctcaatatttgatctctattgatcgtaacgatttcgaaggagttgaaggcgtaccttgtacggaagatgaccatcactttaccgcagaaggtaaaccgacagataaatggcattgcgttcacgcaaaaccggctgttccgggctttgaaagaggtaaatatttgatcaatttccatgatttcgctaataaatatggttggtcaacattatcaaatggggagcaagatgctgactacatgtggaagaaatatgatcgtgcaggtttcgtggaagctatccgtgtagctgatactttgtatatcttgagagatgagttcaagaacttaccgaacgagaagatcaacttcgctgatttgaacaaggctgaggaggatgcttggactgcggctaagaaggctggagtatctgaagatgaatttgtttcacacaaatatatcttatctggtgataaccataagtatgtgacttggtctatgcgtttcgtaaacaaggaagttgccgctaatgaggtagaagctgatagagcattcttgttcgagtctatgaagagtaaacatgtttctgattacaataattctgctatgggtgacatcgctcctacatatgcggcttggttgagaatgcagaatggttgtttagttctgtctgatgatcgttcttctaatttcgatgagatgaatacaggtggtgacgatgctttgatctttaatgtggagcaaggtgatgatatcgcaacagataacgaaacaatcgatgctgtagaaggtatctctgtagtagccggtaacggtaccgtaaccgttcaaggcgcagctggtaagtctgtagttatcacgaatatcttgggtaaggtaatcgctgagaccgttcttacttccgataacgctacaatctctgttcctgccggtatcgtagcagtggctgttgatggtgaggaagctgttaaggctatcgttaaataagaatttaacaaaataagataatcatacaattcccgtgcgggtatcgatccaagtaatccgtgacggatgaacaggcgggagttggattaatattaatactaaagtaataaattaagaggtccgtaagtacctccgtgaggaggaagtacggataaaggaacaagaggatgcgtcgatataatgtacgcatcctcttttgtgtttatagcgggtgttgaggataaatcctgcttctacttgcaaaagagcgagataagcaacggcacgctgatctcgaggataatcccgtgaataatagccacaggtacgatattctttccggaataccggctgataacgggaagacaaacatccatagaattgattcccgccacggataccggagcgaatttaccaaagaaagaggcatacaacggtgccccgaataaagctaacatttcccggatgatattagccaataacgcgatagccccgagttgcgaagcgatttctatccctgccgacgcctctttcagttgtacgataagcaaggaggataaggaataataagcgaatccgcttcctacagccatacaatcatatatattccacgaggtcaataacaaactcgccgccgcagagaatactaacgtgccgatgatcgtaaagaacggcagtaacaaactggaaaaccggatatcctttaccatctttcctaattcggcgtttgctcccagattcaatcctacttggataacgagggcgtatagcaagaattgcggtagtttttcgcaatacgtggagatagtcgtgttggcgaaggttccgcaaaagattcccgctgtgaaacataagataacgattaggttatttttcattgagacctcctttcttgataaataatttataagcgataaaagatgctaccagacttcccaatactccgcaaatagctagtatggcagcttgtattccaaactcaccaatattattcagcaaagattggttggctcctatggtaataccaaatatgaacaacatcgcgaaaatcgtataagagatggaatgttccaatcccttgaaagcggggacgtgtcggcataaataaccgacgcttatccccagacctaatagacctagaatgataaacataagcatattgtattttgagatgcgcaagacatcctttccccggaaacgaagcatacgaatactccctcttttccgcagaagttaaacttgagtgcaattaatacctagatgtaggtgtagaagagaactataaaaagaagtcctctcaagaagagtatgaatggatttagacaaaaccgctgaaccaatgaacatgcacgatcgtgttacccgagaaagctcgggtataccatctttttgagttgttcagaagcttcttgttcatcttatttgtatcattgtttgatttctggcgcaaaggtagtaataaattagagattctaaaactttttctaggatcggatatataagggacttgacttggattttggatctttttatgtacatttgaggtcctacccgctattgggccaactaaaaacggatagaacagatatgattaaaagataagattggttatgaggaaaagaatgattttaacagcattggcggctgtcgctatccctacgttgttgatggcggcggatgaggcgagattaatgcgctttccggctacaaatggttcagagattgtattctcgtatgctggcgatttatataaggtccaggctacaggtggtgaggcacagcgattgacatcgtatgtggggtatgagatgtttccccgtttctccccggatggtaagacgatcgcttttacgggacagtacgacggtaacacggaagtgtacacgatgccctcttctggcggtgagccattgcgtatcacttacacggctacgaatagccgtgatgatctgggcgatcgcatgggcccgaataatattgtgatgacttggacaccggacggcaatggtattgtttaccgcaaccgcatcagcgatgggttctccggtaagttatatacggtaaataaagaaggtggcctttccgaggtggttcccttgcccgagggcggcttttgtagctattcgcccgacggaaaacaattggcttacaaccgggtaatgcgtgagttccgtacatggaaatactataagggcggtatggccgatgatatctgggtttataatccggagaagaaaagtgtagagaatatcacgaacaatgaggcgcaagatatctttccgatgtggattggtgatgagatctatttcctttcagatcgggattacacgatgaacttgttcgtttacaatacgaagactaaacaaacaagtaaggtgacgaacttcactgagtacgacgtgaaattccctagtagtttcgggaatacgatcgttttcgagaatggaggctatatctataagatggatgcggcgtcgaagaaaccggagaaagtgaacgttacccttgcctccgataatgtctacgcacgtagcgagatcaaggatggttccaaatatatcacgagtgccagcctctcccccaaaggtgagcgtatggtggtgacagctcgtggcgaggtattcaatatcccggtagataaaggggttacgaaaaatatcacccgtactccgggagcgcacgaacgtgacgctcaatggtcgccggacggaaaacatatagcatatatctccgacgctaccggcgagaccgagctgtatctccaagattccgaggggggcgagcctacccagttgaccaagaataacgatacgtatattcgtactttccagtggagtccggattccaagaagattgtctatacggatcgtaaaaatcggatcaatcttttggacgtatctaacaaacagctaacaaatatctcacaaagtctgttaggtgaagcccgcaacgtaagtttctctccagataataattggttgacttattcccgtgtgtccgataataatttctcaatcgtctatgtctacgatatcgcgggtaagaaagaatatcccgtgaccgataaatggtacgagtcttattctccggtattcagtacggatggcaaatatctggtattcacttccgcccgtgatttcaatcctacgtatagccaaacggaatggaatcatgtgtataataatatgggtggcgtatatctggcgttattgtctaaggataccgcttccccgtttatggaaacggatgcggaggtagccattgaatctaccccggcgaaagcggatgcctctaaaaaggacgagacaaagaatgaggcttctactccggtcgtaaagattgatatagagtgtattacggatcgaatcgttaagctccccttgccgggatcgaattactacgatctttattccgatggaacgaacgtgtattatttcacgaaaggcggcatgaagatgtttgacttgaagaaacagaaagaggaaaccgttagcgatgccgctatgatggttgatccggctggcaagaaagctgttttctttaaggacgatcaactattcgtaaccgatataccgaagggtaaagcggatttaagtaagccggttaatctggcgaatatgaagatcacggtagactatacgaaggaatgggcgcaaatcttcgatgaggcttggcgtgctttccgggatggtttctatctggagaatatgcatggcaaggattggaaggcgatcaaggagaaatacgccgcccttcttccttacgtgaaaacacgtttggacttgaattatattattggcgagatgatcggcgagctgggagtagggcatgcttatgtgaaccccggtgaggtggaaagtcctaaacgggtatcgatgggtctgctaggtgctgaggtttctcgggataagagtggtttcttccgcttggaaaagatcctgccgggggcttcttggagtaaggaattacgttctccattgacagagccgggtgttgaggcgaaggccggagagtatatcgtcgctatagacggagtacctacgaatagcgtgaacgatatgtataagttgttgatcgggaaggcgaacgttccgaccgagttgtccttgaatagcaagcctcagttggcgggcgctcgtaagatcgtggtcagtccgttggcggaagaatattctttgtatcactataattggatccaagataatatcaagaaggtagataaggcgacgaacggtaaggtcggttatatctatatcccggatatggggccggaaggcttgaatgagttctcccgctatttctatccgcaattggataaagaaggtttgattatcgatgatcgtgcgaatggcggtggaaatgtctccccgatgattctggaacgtctgtctcgtgagccgtatcgtttgacaatgcgccggggttcttctttgatcgggaccgtaccggatgccgtacaggttggcccgaaagtttgcttgatcaataagtattccgcttccgatggcgatttattcccgtggggcttccgtgcgcttggcttaggtaaattgattggaacccgtacttggggcggtatcatcggtattagcggcccgcttccttatatggacggtacggatatccgtgtgcctttcttcacgagctatgatccgaagacgggtaactggattatcgagaaccacggtgtggatccggatatcttgatcgataacgaccccatcaaggaatggaacggtgaggatcaacaattagaccgtgctatcgaggaagtcatgaaacaattaaaagaacgcaaaccgctagcccctgtccccgcaccaagggactggagccataaataatgagaggttatttgtagagatggggcacgcctcgtctctacaaataaatagtaaacggattaaaaactagtaatctatctatggaacgattcgcagccattgactttgagaccgctaatggaaagcggagcagtatttgcagtataggtatcgccatattggaggatgactgggtagtagatagcatttataccttggtacgtcctacccctaatttctatacccgttggactacggctatacatgggttgagcgctgaggatacgaatgatgcgttatgtttcgaggaggcttgggaaagcatcgccccgaaactaaaggatctcccccttgttgcccataacagtccgtttgatgagggatgcctgaaagccgcccacgaggtatatgacttagcctatccgaaatatcccttctattgcacttgccgtctatcccggaagatgtacccatttctggtaaatcatcagttgcagactgtagccgcccactgcggttacgaccttacccaacatcataacgccatggccgacgcttacgcctgtgcccatatcgcccttacgatgatgcgggaaaaagaggtcgataccttggaggcgcttatggcttcctgctactctaggtaactatggggtgtttttcccggctattttatccaccacgacagcgatagcgccatctcccgtcacgttgcaagcggtgccaaaactatccatggcaatataaagggcgatcattaacgcttgcagtgtctcattgaatcctagcatactttgcaagatacccaaagcggccataatagcccctcccggaacccccggagccgctaccatcgtaattcccagcatcatgataaatccgctgaaattggagaaggtaaccggttctcccgccatgatcatgatagccatagcgcaagctacgattttcatggtgctacctgccagatggatcgtggcgcaaagcggaacggtaaagatcgctatattctcccgtacgccattcttgacagcctgcgccagtgtcacgggaatcgtggcggcggaggattgggtccctagagccgtagcgtaggccggtaacatattcttcaagaggcggagcggattcttcccggctatggctccggctatcgtgaattgaatcaataacaataatacatgtaaggcaaagatgactatgataaccttaaggaacatcgtgataatactcatgacttgtccactcacggtcatgttcaggaagataccgaaaatatggagcggtaataacgggatgataaccacctcgatcagcttaatgataatttccttgaaatccgtgaaagagtcacgcagggtggttcccgctatattagaaagccctaggccaatcgtaaaggatagcagcaaggctgtcatgacatccattaaaggcggcatatttaccacgaagtaaggtgtcagcatgaaatcttccggattctccatcgccgtcaattccgtgttggtcggtagtatgtgcgggaatatagccgatccgctcaggaacgtgaagaaacccgagaagactgttgaaccgtaggcgatcaaggcggttatcaataatagctttccggctcctttgcccagatctccgatagcgggagtcaccagccccaatatgattagagggatggagaacgataggaagttgccgaacaatgaattgaaggttacaaagatacgtgcgattcctcccggtaaaaactggccgaacaatacgccggcggcgatagcgataacgactttagttaacaatgatactctgatcttcttcatggtgttgctttattttgaagccaatggcggccatcgtaatactcatcaacggactgatcaggttaaagaagcaataaggaagatacgtcagggtcgctacgcctaatatcgtggcttgcgtcatgccgcaggtgttccacggtaccagcacggacgttacggttacggaatcttccgtcgtacggcttaacaggcgactctcatatccttttttcttgtagatatccttgaacatatttccggtaaggataatagatatgtattgatcggccgtaacgatattcaagaataaaccggagaatacggtagacgccaccatgccgaccctccgtttcataaagcgcaggaatacggacgtaaggctttctagcataccgctggccgtcatggaaccaccgaagcacatggcgcagatgatcagccagatcgtattcatcatacccgccataccccgggtggcgaccaagctgttcaaggcctcgttgcccgtatcgatttgggtactcccgtagaatgtcatgaataatcccttaaacagggaggaggcatccgctaccgacgctcccgctacctcttgcaataaatgaggctggaaaaagatcgcgagcacccccgccatcgctgtcgagataaacaaggtgatcaaagacggtactttcttggcgattaatatacccgttaccaccggtacgatcagtagccagagcgagatattaaaactttcgttcaacgaggcggcgaactcggctatttgcccggatgcgttcgaggtatgcgtaaaacccgctatggtaaagataatcaacgtgatcaccatagacggtattgtcgtaagcatcatataccggatatgggagaacaaaggggtatgcgttacggaagaggctaataccgtcgtgtccgaaagcggtgagatcttatccccgaaataagcgcccgagatgatcgccccggctacccaccccgtagcgaagccctgtgcctcaccgatacccatcaaggcgataccgatcgtggcgatggtagtccacgagctaccggtcataacggatacgacagcgcagatcacgcaacaagaggccagaaagaaactcggatggataatttgcatcccgtaataaatcaaggtcgggacgataccgctgatcatccagctaccggatagagcgccaatcaacaataggataattatagctgtggccactcccaatatgtttttacatatcgcctcttctatatcacgccatttgactttgcagaagatcatggccaaaagggaggcgaccgccgtggtggtaagtaatacgacttggcttccgccgctcaacgcgtcgctgccaaaagtgcgtatggttacaaacaaaagagctaccagcacgaggataggcactagtgaaagtagaggggagggcatcttcttaagatgattttccattgttcattcagtcgcttaaataatgatggtgcgaaaatactaaaaataccttgaatagcgctatgaattatagattgatttccttatttcacagtcttttggacgatcttataaccggttgccgctataagaatgctcataaacgggctgacgatattaaagatgcaataagggaaataagtccaagtagatacgccaaggattgtagattgtgtcatgccgcaagtcgtccacgggatcagcacggaggtgacggtgacggagtcttccgttgtccggctaagcaggcggctctcgaatccacgttgcttatatacttctttaaacatttcgctgttcaggatgatggcgataaactggtccgccgtgcagatgttcaaggataatccggacacgacggtagaggcgaccatgctggtacggcctcgcatgaaatgcaagaagatacgtgtgatgctttccagcatgccgctagcggacatggccccgccgaaacacatggcgcaaatgatcagccaaatcgtgttcatcatcccggccattccccgggtagagactagagagttcagggcctcgttgccggtctgtatctgcgtgctgtcatagaaagtcatcagcaggcctttgatataggcgataatcccgctatccgtgatcccggaaatctccaataaggcgtttggctggaagatcaaggcgaatattccggcgagtatggaggaggcgaaaagcaccacgatcgaaggtgtcttcttggcgatcatgattccggtaacgatcggtacgatcataagccaaggcgtgatatggaacgagcctttcaaggcttcggagaaagtggctatctgggatgcgtccgctgcctccctcgagaatccggcgatgctgaatacgatcagtgtgacgatcatagagggaacggtcgtataaagcatataccggatatgcgtgaaaaggggcgtgtccgttacggaggccgccaataccgtagtgtctgataacggcgacatcttatccccgaaataagcgcccgatataatcgctccggctacccaccccgtactgaagccttgcgcctcgccaatcccgatcaaggcgatcccgatggtggcgatggtagtccacgagctacccgtcataaccgatacgatactgcatagcaggcaacaggccacgaggaagaaatccgtttgcatgacttgcaacccataatagatcaaggacggcacgatcccgcttaccatccaactgcccgatagggttccgatcaataaaaggatgatgacagacggtgcgatcccatagatgttacgggcgatttgcccctcgatatcttcccacttgatcttgcaatgaaagacggcgatcaaagagcagatcgaggtggctatcaataagacgatttggctggctcctccaagggaatcgccccggaaaatatagatggctacggccagcatgatgactaatgtcactacgggtagtaaagagatcgcgatggagggtgtccggggcttttctgccatgggtttattcacgtcgtttgttatttatcatggataatccgaataaattctttatacggaccttccttgtgttatcaattctaattaatttcgctgcaaaaataaaaaaggatttggataggggggtaacttatggtagtaaataatcggttaggctatttatttgtctttttggggatgagtatggcgctatatgcccagcgaaagacggaagtgatccgttatggcgatctggatcagtgggtggtacgtaagatcacggaatcggctattatcgggaaggagacaaagactctttactgcgttggccctatggatacgattatcggaaataaaccttttgagccgaaagcttcgccttggggcagttctaacgtgatggcaagggtgagcgggattacgaaagctagcgtcagtgtctaccccgaaagacgggatgaggggtattgcgcacggctggagacgggtatagaatcgatctcggcgatgggtatcatgaacgtgaaggtgctggtcggtggatgcctctatctcggccgttttctggaaccggcgaagaattcttcggagacgtgggggcagatcgtttgcggtatcccgtttcaccaaaaacctacgtccttgttattcgattataaggtgaaactctccggtgatcccaatcgtattaaattgagtggttttagcaagagatcggaggtaaatggcattgatatgcctttggtgaatctctttcttcagaagcgttgggaagataaggacgggaacatatatgctaagcgtatcggtacgctggtaatccggatggatgaaaatacggattgggtaaacgatgccagttttacgatcttatacggcgatatcacgaaacgtagcgattatgaagaatatatggggtttcaactcggtgagtccgcccgttatagcttgaacagcaaaggcaagaatgtgcccatccaagaaatcggctggggaacggaggacgatgaggtaacccatatgatcttagagttctgttccagtcacggaggctcatacatagggtctccgggaaataccttttgggtagataatatccggttgggatattgatcctattatcgttgaaaccctatggtatttgtctccggtcttgatacagaagccaacaaatgaagcgtagcttgttttattctatggtttcgtgatcagaatataatagtctgatattagcctctaatattctgaatccactcccatggtcgtgcggcataccatatttggggccagatttatagctcccgattcttatatcatacattatcttcccatcggttaagagtgatataaaacgttcaaatgatggctctgtatatatatcggctttattgaagtagaagagttccttacctccttcttttttcgtttgggcagttacatataataagttctttagcttctttgttagtgctttttgaatgtcttgataggtgtaacctatgctacaatctaacagctcttttgtatttaagtcaaatactcctattaatattgtcttggcgacagggttgtttaggagtttaaaagaatatttcttcatatatgtgttatagctatttgcaaacatagacgtatgcaagctatttatagatggtgcatcttcataaggtgtgccaaatttatcttttaaataagcattcgcgcgtttgggaaatgaggggcttttagtgaatagggtaacgtaagagcatgaagcgccgcgatgagattttatttcgaatccagctaaatcgggctcgtctaaattgttctcgacaactccgatgtaatcttcaaatgtttttccaatcccagtattgttggctctattgcttggaacatattccaaggatttaacctctttgaactttgaaataataaaatccttattctccataacgtattatattaaatatgagtaagtcaataatatctctatctttggaaaaatcttcctctgatatgaatagctgttctatggtaatgttgaaatagtggcatattttatagatctgactaagggtgtacttatgtggaaatttagggctttctatactccctattaagcccggagccacttcgaggagattcgacaactctttttggctaacattgttggcctctcttagctcctttatcttaaggatgatttcaagttgatactcggtctttctaatcattattgttatttttgcccaaaaatatagttttatatatgcttatgtactcacaatatgtgagcaattgagtatatttgcactcacataatataagtaaggaaggtatgtacaaaagaacgattgataataggtggagctttaaggatgccgataccaaagaatttactcattgctatcatgcgtatcctgcgatgatgattccccaagtagcaagagctctaatagaggaatataagccagaggatggagttgagctactttttgatccatatatgggaagcggtacatcgttagttgaggcttctataaaaggtataaacgcgataggaacagaccttaatccattggctagattgatgagccatgtaaaaacaacccattatgatttatcttgtatcagagatactttttcaatgatgcaagccttgttctttgagtattctgaagataaggtcaagaataagaatttcgataatatttctaattatacttattggtattccagagatagccttttgcgcctttcttatatttatcaagtaattaatgaatgtgtggctttggatttcgctgatttctttaaagttcctctttctgagactgttagagaggtgtcgtttacgaggaatggagaatttaagcggtttaggatgaaggaagagaaaattaaagacttcaaaccggatgtctttcgattgtttgaagaaaaggttataagaaatataaatggacttgaggagtttaatagtataaaatatccatgtaatataggtatctatgactttaatagtactatagaaatcccttccgatataatacagccgaatagtgttgatatggttgtaacctctccgccttatggcgatagtagaacaaccgttgcttatggacaattttcaaggtgggcaaatgaatggttcaattttgaaaatgctaaaacactagataatctcctaatggggggacgagttcagaaagaggaactttttgagactaaaagcattaaatctgaactggacgaaataaagagcattgacccaaagagaaatttggaagtggtctcgtttcttaatgattatagctgttctataaagaatgtcgcgtctgtaataaagagtggtggagtcgtttgttatgtcgtagggaacagaacggttaagggggttcaaattccattagattactttactgctgaaatgtttgagaagaatggttttacacatatcgatactattgttagagaaatacctaacaaaaggatgccttccaaaacaagtcctactaatgtggcagggaagaaggttagtacgatgtgcaatgaatatatagtcatattggagaagaaataaggaaagaggctgttttatttgactgaattgatagccaatggctcctagtgtcgagttctttctttttgacagtttgtaatcttaacgcccgtagaatcgattattgcgggggaatgtacagtctactcttaaatttgagttaaaatatatttaatcgcttgttggatagttggatatcaaaagatgctcttttgttctagcgaaactagctcatcctaattcctattttatgggatgaaaaacctatctcaatgggttacgatagggaagtgacagggttatgatggctattcttgatagttcacgaccctattcttgactattcacgatgcccaacggcactattggcgttgccaaacacgaccgatagcgtaggcttttgtcgatactcgtgtgtaaaaagtagtactttgccgcataaaacgccgcttacaacctcctttttcccattatcttgcctcttttacgaataggctatgtcacgatatgcgctttatttcggtcaaaaggattgtatgaatgctgttttactgacagggagattcgcgggaaatagtctgtattggaagtaaaatataaatagataattgaaagtagaaatgaattgttcttttaatgtacgctcgtacattaatgtatagttaaatacgttgatatttgagaattttttatgggatagaaacgactagtttaaacgatcgattcttttagtcatttgcaaaggtacgcgtttcttcgatacttgcaacccttccgagctatttttttatcacttattctctttcttatcaataggataggttatcctctacgaaacaaccgattctttcaacaaacctcccgtttcgacactaaaaaaacgcaagatttagacgatcgtttagactagtcgttttcgagtagtggtcgatgatttaaagtgttgaacggtatttaattaacactattattaatattaaattttcgatttatgaacaaaaagtttacaacgtttctggctagtgccatgcttgcgactgcattttccgcaggtgcgcaggttgatgcgaagaaaggcgacgtaatcttgttgggaacagaaagtagtaaatacttgactgttgagacaggagaacaattcggcaaattgaacaattcggtgaatgtttcaacgaatctttcttccttgaacaaggctacttggactgtttccgctaagaaaacctctttaggcaaagacctttattcattcgtgaataaggctacaagcttgactttggctgtcgatcctgctacggcttacagcttggaggatacgaagaattcaaagaagatcgctcttacgttaggtggtggctccgctacagaatgggtgagtgaaacggtaaataatgtaaatactatcgtttcttacaacggagattatatcttggctattgctaatgatcctgcgattggttattatctggtcaaggctaagactttggataaattgggtacggtagttgcgttaaagagcgagaaacctagtgagactccaatgcctttaggtgctgatgacttgaatacattattgcaatcagtagagacggacaaacctgctgagttgttctttggattgaacatggatccggaagttacgaaagggcaaagcaatttaatgacagctacggctttgaacgctcagaatgctggtagtggttatgtttatttacaggctaaagatcaaaaatttgatgggaaagatgcttatgtagttgttgatacggcttactatggcggtacggaatccgacaagcttttgaaatatacttatgaccatatggagtatgcagataaggctaaacgtctggacggctcatacaagtttaagttttcttataatgctgcgaaggaagaattgtatgttcaagtagcggaggtagctcatgaatataagaaaggtgataagaatgacgatcaatggaaagcattcttgaaagagaacaacaactctacgtggactcagagtggtacgtcagagccactggaaatagttaaagacgagtacatctacatgtctcaattgaacggtatgaatgtattgactgtcaatgttgcgaaagatgaggacggtgttggtactcgtaagggcactgatggtagtggcaataaattatatcctgttctgggcgatcagaacgtaaaggttacgatcggaacgaagttcacaggcttgacattgacaaccattcctaatggtgtctatacgatccagtataaatctacaggtggaaaccaaccggagaaaaatggcacttacgctttggcgaacttagccggaagtttcggttggacatatcaagctaagagacaagatttcaatcatatacctgccgctcaatgggtagttgagaagaacggtacttccaatacggctacagtaaatatcacgaaccgtgagttcaatgatagattaaagactacttctcctcttcagttctttaaggtggaaggtagtgatgatgtattctgtttctacggacatggaactgataccttgtctttcaagaaagttgcggatgaattggttgccgacaagaagttaggttacaaatatgtatccgctgatgaggctaaagttcagacttatacctttaattacttgcatggtttggcattagataaatatctgtatactcctgcaggtaaggactctatcgtacgtgtagacgagaacgacggtaagtcaaacttccgtttggaattggttgtagagaatgatacgtacggtgttggtgatactttagtgagaaatgtttattatgtatataatgctgttaatggcgagaagcgttacttatcttatgacggtaccgcaaagaaatacatgatgaagaaaaatccgaccccattcttcttaaaagagaataactgcatcgatggtaagcattattatgcgttggtagaggcaagctttaagacttatacgacagatactaaactgacttcggatctgtattataaaggaggagatggctactattattctgtaaaatggaactatttatcttatgaagatgataaaggaactacatattattcatatatagtaaatgataaagatggtaatcttgttgttgcggataatagtaaggaggatgtatatctcttcactaaggaaaacggtaagtttgttctgaatgaggatcctacagcggaagattatacaaatgagtctaatggatatgctaaaattaaagtctctgttgatgataacaccttggatctaacacaaggtaatttgaatgacaagttcaatggttatcaagaaatccgtacttctgcattcgctgtagagatcgatgactctccattataccgccgttttaacaacactgtgttaggtgagaacgaaaccgctgatagcttgtactttgtagagaagactcgtggtgagtacttgatggatgaatggaacaagaacttactggataaggatgttgattacgccggtatctggaacaaggaaaaggctaatggcaaattggcattcatcatcgactctgtttgggtaaatcgtggcttgggtaacatcaaacctcaatatttggtttctgtggctcgtaacgaccaagccggtactccgggtgttccttgtacatacgaacacaatcactttgataatgcgggtcatcaagttagtgccgctgagtgttctcacgctactaaggcccatgctggtttccattatggtaagtatttggtaagctttggcgattccgctatgatcaaggatcacgaattggagactccgtatatggatattgatggcggttacactcgcgtaggtttcgtgaaggctattcacgcaggcgacagcttgtttatcttggtaaatgagttcaaggatatggatccggctaagttggacgtagctgatatcatcgatgcatacacgaaagctaagatcaacacgaagtatatcgtgaacttgcaaggtgacaaccataagaacgtaacatggtcattccgttatgtaactccgtctaatgtggctggcgtaacggctgaggaaggtgaggctaatgagttcttgttcgaatctaacatctacaatgagggtgctacttcaactcttgatgatgtgttggtagacagcaaggataagagcaagggttatatctctttgggtggtaaagctactaagggttacaatgaggctgtagccggctccatcgctccttcttacgccgcatggttgaagatgcagaatggttgcttggtattgactcgtggtgattctaagtttgatgcagctaagactggttctgacggtgccttgatcttcaacgcataccagaagactgacgctgaggatatggtaacatctatcgaaggcgctaacgctgaaggcgtatctatcgtagccggcaacggtactgtaaccgttcaaggcgcagccggtaagtctatcgttatcacgaatatcttaggtaaggttgtcgctgagactgttcttacctccgataacgctacaatcgctgtacctgccggtatcgtagcggtagctgttgacggcgaggaagctgtaaaggcaatcgtgaaataagaaataaacgaaataagataatcatacaattcccgtgcgggtatcgatccaagtaatccgtgacggatgaacaggcgggaattggattaatattaatactaaagtaataaattaaagttcatccgtaagtacttccgtgaggatggaagcggataaaaaaacaagtccttggcaatgtgttcgcatgccaaggacttcgtgtttatacttgccttcgtcagacctaatgagtgtatgaattgtttaattctgcgtaagcaacttcgtcagcctcttgaccccttccgaggctccggcctgtatatgctcgatgtcgtcgcgataagtacgtacatctttcgggtcgatcaaatagatcggctggccccgacgcacgtagttcagcaaaccggcggcgggatagacgtttaaggaggtgccgataatcacgaagatatcacaatcttccaccagcttgatggaaggctctatcatgggtaccgcctctccaaaccatacgacgaaaggacgtagctgatttccgtgagggtccttgtcacccagatgaatatccgggttctccggcgatagatcgtaggtcgtgtccagatcccttacggagcatgccttcatcaactctccatgcagatggatcacgtggctgctacccgcgcgttcatgtaagttatcgatattctgggtaatgatccgtacgtcgaaatctttctccaaggcggctagcccgaggtgaccggcgttaggtttcgtattcaataactctcttctgcgctggttgtagaagtcgagaaccaatttagggttggcggcgaagccttccggcgtggcgacatcttccacccggtatttctcccataacccgtccgagtcacggaaagtggagataccgctctctgcgctcattcccgctccggtaagtatgactaactttttcatctgttacttgtttaatgtatagatgtatatattaatagttacgaagttacgactttatttcgtaaaaagctttgaatgaaataaaaagttcttacaaaatgctgttatacgattaaaagcattacttttgtggcttataattagttgaacaagaaaaaagaatggataaagtaagttatgcgcttggcttaagtatcggaaataatttccagaactcaggcatcaaggatcttcaagtggaagattttgtacagggattgaatgacgtcttaacagaggcaaaacctgctcttagttatgatgaggcaaaacaagtgatcaatgattacttcatgaagcttcaacaagagaaactggagatcaataagaaagccggtgaggagttcctttctatcaataagcataaggctggtgtggtagagttgcctagcggtttgcaatacgaggtgctgaagaatggtacaggcgctaaacctacggcgaacgataaggtaaaatgccactatcacggtacgttaatcaacggtcaggtgtttgatagctccgtacagagaggcgagcccgccgtattcggtgtttcacaggtaatcccgggatgggtagaggctttgcagttgatgccggtcggttctaaatggagattgtttatcccgtctaaccttgcttatggcgagcgtggggcaggtgaggctatcgagccgaatagtacgttgatcttcgacgttgagttattagatatcgaaaaataatatataagagttaaagaaaaatgaaaaagttaagtgtattagtcgctacagtgattgtagcaatgggcgcatctttcacctcttgcggtgattctcacaaaagcgcgagcttgaagacttctatcgatagcgcaagctacgctattggtatcagcacaggtgccggttataaggaaaacttaaagactttgccgggtggtgaggctaacgtagatgatttgatcgctggttttatccaagctatcaaaggggattcttctgcgatgaagatgaatccgcaacaggctcaacaatatttgcagacttacttcgtagaggctcaggctcgcgaggctaagaagacaaaagaagagggcgataagttcttggcggagaataagacaaaagaaggcgttatcacgactgagagcggcttgcaatataaggtagagaaagaaggtacaggcgcgaagccgaccgctaccgataaggtaaaagttcattataccggaactctattggacggtactaagtttgatagctccgtggatcgtggcgagccggctgagttcggtgttggccaagtaatcaagggctggactgagggcttgcagatcatgccggtcggttctaaatatatcttctggatcccggctgagttggcttatggcgaacgtggcgcaggacaagatatcaaaccgaacagcgtattgaagttcgaggttgagttgcttgacatcgtaaaagaataagtagcgaagaaatagaaacggaacgtttgtaagataataggcgggcaaattatgctaaaaagcattttttgcccgcttttattatttattgattacttttttctttcagaatgatatatgattcaaatttattatatacttttgatacattaaatctgaatgcatataataaagcgaatttaaaatggagaagatagacaaactggaccggcagatattgaacattatttcaaagaatgctaggattccttttaaagatgttgccgaggagtgcggtgtatctcgtgcagctattcatcaacgggttcaacgcatgattgatatgaatgtgatcgttggctcagggtatcacatcaatcctaaaatattggggtataatacatgtacctatatcggcgtgaaattggagcgtggatctatgtacaaggatgttgtcccggaattcgagaaaatacccgaagtggtagaatgccatttcactacgggtccgtatacgatgctgatcaagctgtatgcccgtgataacgagcacttgatggagcttttgaactccaagattcaagagataccgggtgttacggctacagagaccttgatttctttacgccaaagtgttaaacgtgagatccctatctgtaatatcaatgaataagacgaagaattatacatgagcccggcctattccagtgccgggcttttttgtttattcggcggtatcatctatctttgtaattcgtaattgtgtgaggttctatgagtaaatatataggaatattcgttttcgtattcagtttgttttctttgggagtacatgcgggggaaagttttcgttttcgggtgtatttgaaagataaaggggattccggttatacgctggataacccggaggaatatctttccaaggagtctgttgagcgacggaaccggcaaggtatatcggtgtcggaatcggatttgccgatcgctcaagcttatctggataccttgtccgccaatggaggaaaaccggtgctggagagcaaatggttctctacggtcgtggtgtccagtccggatagcttggtcgctgagcgtctcttgcgcctcccgatcgtggattccgtgaaatgggtctggaaaggtgacgaggaaatcgatattcctagggaggagaatgatacgacacggtttatgccaatagataaaccggagaaatcgccttacggttatgccgaggagcagatcaagatgctgaacggtatcaaattgcatgaggcgggctttaagggtaagggtatgcgtgtggccgtggtcgatgccggtttcatgaacgtggatcggatcagcgtatttgattccttgcggttattaggaacgcataacgtggttttccccggccgaagcgttttcatcggggatgatcatgggacgaaggtcttatcttgcttggccgctgatgcgccgggcttgatggtcggtacggctccccaagccgaatattggctgataaagagcgaggatagccgttcggagtttcccatcgaggaggattattggacggcagctatggaatttgccgatagcgtgggagtggatgtggtctcttcttcgttggggtatttctcttttgatgtagaggccctgaactatcatcaagatcaattggacgggaggacttccttgatcagtcgtgccgctaagatggcttcatcaaaagggatcttgttgtttagtagcgccggcaacgaggggggcggtagctggggaaagataacctttccagcggatgccccggatatattgacagtgggcgctatcacggatcgtaagaagaaaagtaatttcagttctgttggctttacggcggattaccgggtgaagccggatgtggttgccttgggtacgggctgttgcgtgatagatcctacggggaatatccgttacgcgaacggtacctctttcgctacgccgatcttagcggggttgggtgtttgtctatggcaagcgtttcccagtctgacgaataaggatataatctctcttttgcagcgtttcggcagtaagtttgagcaaccggacgctgagttgggatatggcatcccggatgtgtacaaagcttataaacaagagcgtaaatatgcggccgaatctaaataacttatcgggtgagaaagaggctctatctttgttagagctgaatactcgtatacggggtgcgttgtcgagggctttcccggagacttgctgggtgcgtgcggagatgagcgatgtgcgggtgaatacttcttccggacattgttatctggagtttgtggagaagaatgtgcagaccgggcaattggtggccaaggtacgagggtctatctgggcgaagacgtttcgtatgttgaaaccttatttcgagatggagaccggtcagatgttcgcttccggcttgaaagtgttggtgaaggtgtctgttgagttccacgagttgtatggattgagtcttacggtgcttgatatagatccggcttatacgttaggtgatatggtgcgtaagcgtatggagattatccgccaattgcaggaggaaggggtctttacactgaataaggaattgccttttccgctacttcctaggagaatcgctatcattacttctccgacggctgccggctacgaggattttatgaatcagttgacacggaataaaggaggttatccgttctataccaaattattccccgccttgatgcagggagaacggacggaggcttctgtaatagcggctttagaccggatttatcaacatcaagatctttttgatgtggtcgtgattatccgtgggggtggggctacctcggacttgaatagcttcgattcttatctgttggcggcgaattgcgctcaattccctttaccgattatcacgggtatcgggcacgaacgggatgatacggttgtagatttggtagcgcatacccggatgaagacaccgaccgctgtcgccgagttccttatttcccgaatggatagcgttggtgaggagttggagagtttgcgtcaagacgtgagtttattggctatggatattctatcccgacagaaaaactatttacaattggtagcgacccgtttcccttctatcgtgacaagccggatcgagcggaatcgttcgggactgcaaacgatagcgagccgtttacctgcgatggtatcgggtttgttatcacgccgccagtcggtgcttgagaatacggaacttcgcttgcggaacggtattacctctaaactttccgagagtgggcgttttatccagcttacggagcagtttatcaagatggcttctcctgattatatattgaagaggggatatagcttagccttgaaagatggcaagattatcaaacatgcctctgatttgcgagccggcgaagaactgacgactcgcttcatcgatggtgaaataaaaagtattatcaaaccatagagggtggttttataaccgtccgataaatacataattaatatggcgaagaaagaagaaacatataacgaggcgatcgagaaacttcgtaagatcgtggctgagatcgagaatggagacttggatgtcgatatcctgtccgagaaggtaaaagaagctacccgtctgatcaagctctgcaaggagaagctgtataaagtggatgaggaagttaaaaaagttttggaggaattggattgatggataagtacgtcttgatcgttgccggggggaaagggcttcgtatgggtggagatctgccgaagcagtttattcctatgcgggggaaacctcttttgatgcatacgttagaggcttttcatcgttgggatgcttccgcacgtataatccttgtgcttccggaggatcatcagccgtattggaatatgctttgcaaggaaatcggctgcaaggtcccgcatgcgatcgtgaaagggggagatactcgcttcttctcggttaagaatgggttggattggcttttggcggagaggcgtcggaagggggaggaggatagcggtctgagtttggtcgctgtgcacgatggcgttcgtcctttcgtctctccggaggttgttgaggcctgctttgataaagcggctgtcacgggagccgttatcccggttgttccgatgattgattccctgcgtgagacagatgaaaaagggagccatccggtggaccgttcccgctatatggctgtacaaaccccgcaagtcttccatttggaattattgacaaaagcctatgagcaaccttattcgtctttatttacggacgacgcttccgtggtggaggcgatggggcatgcgattgatacggttcccggtgatcgtgagaatatcaagattaccacgccctttgatttgttaatagcggaagcgatgtttgcccggtaaaccctaaaaactcatagatgttatgctggaccttgataaacgatcgattacgtatttgccgggagtaggacccaagaaggcggatatcctgcaaaaggaagcggggatatcgtcgtatgaggacttgctcttttattttccttataaatatatagatcgcagccggttttataaagtagctgagatcagtgggaatatgccttatatccagttgaaaggccagattctctatttcgatacgctaggcgaggggcggagtaaacggctggtcggtaagttctcggatggtacgggcacgatcgatttggtctggttcaagggcttgaattatgtgacagataagtatcgtcccaataccgagtatatagttttcggaaagcctacggagttcgggcatacctataacataccgcatccggatatcgactcaatggagcaagctgatcaagtggcgaatggcttgactcctttctataatacctcggagaaaatgaagaaatctttcttgaattcccgggcgatccagaacctgcaatatacgttgttaagctggctgaactgggaacttccagagacgctttcccccgacgtattgaaacggatccatatgatgtctatgacagaggcaatgcggaatatccatttcccggaatctgccgctaagttgcgtgacgcccagttacgtttgaagtttgacgagcttttcttcatacaattaaatatattacgtaccgctagcgttcggaaactgaagctaaaagggatcgttttccctacggtcggccattatttcaatacgttctataaagagtatcttccttttgagttgacgaacgcccagaaacgggtagtccgtgagatccggatcgatatgggtagcgggcggcagatgaatcgcctgctgcaaggtgatgtggggagtggcaagactttggtaggcttattgtctatgctattggcgatagataatcattgccaagcttgtatgatggctcctaccgagatattggcaacccagcattatgcgacgatcatgggattcctgaaagatatggacgttaaggtcgctcttttgaccggatctaccaagaagaaagagcgggataagatattaccggctattgccagcggtgagatccagatcgtgatcgggacgcatgcgttgattgaggagacagtggttttctcttcgttgggattagcgattatcgatgagcagcaccgttttggtgtggagcaacgctcacgcctttggacgaagaatgcgatcgtgccgcatgtgttggtgatgacggctaccccgattccccgtactttggcgatgactttgtatggggatctggatgtatcggtgatcgatgagttacctccgggacgtaaaccgatacaaacgcttcatcgctatgataataaaaaggcgcaattgtatgagttccttcggaaagagatacaaaaggggcgtcaggtttatgtggtatatccgttgattgaaggaaatgagaaactggattataaagacttggaggccggttttgagacgttcaaggaggttttccctgaatataaggtatgtatggtacatggccgtatgaaagcggcggataaggataccgagatgcagaagtttatctccggcgaggcgcaaatcttgatggctactacggttatagaggttggcgtgaacgtgccgaacgcatccgtcatggtgatcgagagtgctgaacgtttcggcctctctcaacttcatcagcttcgtggccgggtaggacgtggtgctgaacaatcctattgtatcttggtctcatcctataaactaagtaatgatactcgtaagcgattggagattatggtgaacagtacgaatggctttgagatcgctgaggcggatctccgtctccggggacatggagatttggaaggtacccgacaaagtggcgaggggatagaccttaaaatagcggacttggcggccgatggacaaatacttcagtatgcgcgggatatcgctcaaggagttcttgacgaagaccccgaattattgtccgaacagcaccggatattgagcgaaaggctcaaaactctgttcacaaggaagataaattggggaatgattagctaatatgttgtgaaacatattgttctgtaagtctttgatatttagcttgtttattcgcttgttttgcttttattcaaagtcattgcagaaatttttcgttaatcaattttgtcggcttattcaaatttccgaactttgacaagttgacaatcaggcagagatgtcgggtattgccgttttatcctgaattataagaatgaaagttatcaaaaaatgagtataaggacatttctattcatttgttgtgccgctgtgatggtatcgactgctaatgcggagaacccggtgaaaccggaaactccggagactcccaatcatccaacccacaaacttatggacaagcgtgtatctgagttaatggctgaccgtgttggctttaagaaagatatggctttgaaggagcttgcggagattaatgaaaaagcggagttggaggcgagagagaacttgatgttccctgccgatgaattatatggcgaatggacaaatgaatgggtgaatcctttccggggtaaaaaggtagatatgccggattcttgcgtgattgattgttcggcgtttgttttgccgatcgatacgatgatccgggttacctctaagtatggccctcgccggcgtcggatgcataaaggggttgatttaaaggtacagatcggtgatacaatccgtgcggctttcgatggtaaggtacgtattaagaatttcgagcgcagagggtatggctattatttagtggttcgtcatccgaatggtttggagactgtatatggccatttatctaaatttttggttggtgtaaatgatatcgttcatgcgggagacccgatcgccttgggggggaatacaggacgttctaccggttctcacttgcatttcgagactcgtttcttaggtcaggctcttaatcctgccgatattattgatttcgagagttgtgcgcctcaccaagatcaatatgtatttcataatgtaaagatcaatggacgcaagagtaatatttatacatcctcaaatgagcaaatggtttatcatcgtgtaaaatccggtgacacattaggcaagatcgctcgtatgtatggtacaactgtgaatgagctttgccgcttaaatggattgaaaggtacttccatgctgcgtatcggccagtccattcgttgtagtgccggtgtggaaaccgcggctaaagcgactccaaaagctcaaactcaaaagaaatcgactgcttccgtatcttctaagaaaatcacggtacaggcaagttcttccgctaccgcttctttaggagaagacacgaatacaatgaatgatgtggaggctacttcggtttatcatcgtattaaatccggtgatacgcttggcgctatcgctaaaagatacggtacttctgttagtaaactctgcgaattgaacggtatcacaaagactaccgtgttgcgtttaggacgctcattacgctgttcataacgatatataagatgtaaggaaacgaaaaggagccgcttataaagtggctcctttttgttgtaacctcttttcatttatcttattagcttttgttgtcttgaattttcgagaacatctacgtcttttttcctatattcgcgggtataatctaggatagtatgccaaatacaaaggaacaattcgagcaagtgatctccctgtgccgggagttgttcgagaagaagttgaaagattacgggccgtcgtggaggatcatgcgcccccagtcggttaccgatcagatatttatcaaggcgaaccgtatccgtagcttggagatcaaggggacgagcatggtggacgagggaatccgtccggagtttatcgctatcgttaattatggtgtgatcggcttggtccaattggcgttgggatttgcggatacgaccgatatcacgatagagaaagccttggaattatacgataaatacattgcggagacgaaggaactgatgtacgccaagaatcatgattatgatgaggcgtggcgcagcatgcgtatcagctcgtatacggatcttattttgatgaagatttatcggactaagcaaatcgagagtcatggaggcaagacgctcgtttctgagggagtggacgccaactacatggatatgattaattatgccctcttcggtttgatcaagctggagtttggtgaggagtgagctacatggaatataaggaaaccgtaaagaaagtgatcgcagaggtctgccgcctgttactgggagtagtctttatcttctccgggacggtgaaggctgtcgatcccatgggaggagccattaagattggcgactatctgacttcctttgggctggataagctgcaaccttttacggtattgatctccttcaacttgtccgctctggaattcatgctgggtgtctgtatgctattaggggtgtaccggcggtatacgaccttcttgaccttgctgatgatgtctttcatgacgccgctgacgctgtatctggcgatcttcaatcccgtatcggattgcggttgcttcggggatgccttggtgatcagtaattggcagaccttctataagaatgtcgtacttttggccgccgctatttacgtgttcatccataatcagcggcttttacaaggctatacctaccatgtctactggttcgtggctttgtggtcatatgtcttcgctatcggtttcgcttaccggaattataatcatttgccgatcttggatttccgtccctataagttgggtgcgaatatccctgccttgatgtcgataccggaaggtgcgcccgaggatgaatatgcgtattcttttatttacgagagggatggcgtacagaaagaattttctttggagaacgctccggccgatgatagcacgtggactttcgtggattcaaagaccaagctgatcaaacaaggatacgttccccccgttaccacatttcatatttataatgagaatgacgcagacgtgactgatgagttgctgaacgacccgaaaggtctctttcttttgatcgccccccgtctggagaatgcggatgatgagcgtattgacgagatcaacaatgtatacgattacgccttggagaacggtttgggcttttattgcgtgacgggttcttccgccgaggctatcgctacatggagtgataataccggtgccgagtatccgtttcttatggccgatgatgtccttttgaaaacgatcatccgctccaacccgggattggtcttgctgaagaaaggtacgatcttgatgaagtggcattacaacgatattccacaggaagaagacctgaaaacgatcgtaaacggctatctggaaggaaataccgactggaaagcgaaagaagatgcccggctaataaccaacctattaagttttaccgtacctttgttgctggtttggggatacgatgccttgcgcaatcgccgtcgccggaaaggaaaagaatctgaatagagatttatttgtattacatatttaaattattaagttatgagaaagaatattgttgcaggaaactggaaaatgaacactactcttgctgaaggtcttgctttggctaaaggtttggacgaggctttgaagggtaagactccgaattgcgatgtgatcatcggtactccgttcactcacttggcaagcgttgctgccgctatcgatacaaacaagatcggtgttgccgctgagaactgcgctgacaaggaaaaaggtgcttatacaggtgaggtttctgccgctatggtagcttctactggtgcgaaatatgtgatcttaggccactctgagagacgtgcttattatcatgagactccggaaatcttgaagacgaaggttgagttggctttggctaacggtttgactccgatcttctgcatcggtgaggttttggaagagagagaagccggtaagcacttcgaggtagtagacgctcagatcgctggttctttgttcgacctttccgctgaggatttcggtaagatcatcttggcttacgagccggtatgggctatcggcacgggtaagactgcttccgctgagcaagctgaggagatccacgctcacatccgcgctactttggccgctaaatatggcaatgaggtagctgataactgcacgatcctttacggtggtagctgtaacgccggtaacgctaaggaattgttcgctaaaccgaacgtagacggtggtttgatcggtggcgcttctttggccgttgacaaattcatgccgattatcgaggctttttaattaattcataataagaaggtatctttcccctcaatgaatggggaaagatactctttttaatattctatctatgaaaagaattccttgtatcttattgctatttgcctttttgatggccggtacttcatctttattcgctcagacggcgttggaaggtgagcgttcgaccatattcgatgcgttgcagagatccggtttgggaaaaggcgaggtcgttatcaatcaatccgccgctatctgcgagatggtgggtgagcgtatgcgtggagcgaacgtggagacgacagatagccttaccttcttgaaggtacaagggtatcgtacgcaggtattttccggtaacaaccaacgggtctcgaaagacgaggcttttcgtaaggagaaggagatcaaggagctttttcccgaggtcccgacctatgtcacttacaacgccccgttctggaaattgcgtgtaggggatttccgctcacatgaggaggcttatcatatgatgcgcctgttgatgggcgctttcccgaaatacggaaaggaaatgtatatcgtacgagaagagataaaaattcccctaaattaaagatgatgtcagaagtaaacgaagagacgctatgtgcccgggaagctttggccggccattataaggaagtattgggtttgctgggtgaggacgtggagcgtgagggtctgcttaaaacgccggaacgtgtagcgaaagcgatgcagtttttaaccaagggataccatgaggatccggaggcggtactccgttccgccatgtttcaggaagaggattacaaacagatggttatcgtgaaagatatcgatttcttctccctttgtgagcatcatatgttgcctttctttggcaaggcccacgtggcttatatccccaagaaatatattacgggcttaagcaagatccctagggtagtggatatcttcgcccgccgcctccagatacaggagcgtatgacgatgcagatcaaggattgcatccagaggaccttggacccgttgggcgtgatggtcgtgatcgaggcgcagcatatgtgtatgcagatgcgtggcgtggagaaacaaaattccttgacgactacctctgatttcacaggctttttccaacaagctaagacgcgcgaggagtttatgaatctgatcaagcataaccgctgatgacttaatacaagtcggcatgcgtaccagtatcggtcatgatcaagaccagttcggtatcgttttgttgccatattaagagccagtcgcttttaatatggcattcccataggccctcaaatttaccgcttagtttatgggggcgatattggttggggagcgtaccggtttcttgaagaatatcgataaccctttgaagtagatgaagttctaatccccttttcttacacgttttaagatctttcttaaaattcgtggtgtattccaatcggtacatgggtcaaccaaggatttgttgaaacatatcttctgcgtttttcgctttgtgtgttcttccggccttgatatcctccagtcccttctctataccggacttcttcctgccgatattccaaccgaatttcttggccagttctttgagcaaggccatgtctacctccggtaaggtaatttctactttcttgactgtcacttccatatcttgggttgtttatagattgtatgtgacaaaaatacgtttttttattgaattgataatcatctttgagagatttcgagaaagacgatcgaaggatatgacaatctgttaggattgacaatttgtaatcggaagtctcggagaatcggtttttccgggctaaggtacgtcttgtgcttgaatttgaaaaaataaatcagcaatcggttcattgatagagcaatgccgaaaaatagccttttgttctagcgaaaataattcatcgtaattcatatccgatggagcaaaaggagggaaaaacggtgttacgatagggctataaggaggtaagaatgctcattcacgactacttacaatcctatttgcgactgcttataatgcccaatggcactactggcgttgcttaatgcgaccgtatgtgtaggcttttgtcgcctaatgtgtatcgaaaacggtctttttcattggaaaagcactgtttattgttatctcccttcctttatcttgtgattcctgtgaaaatgagaggtcatggaaaagctctaatactactcaaaaagacagaaaagtctcttcgtggatgaccttatggaaatgagaattttgcttgatcaacagctagaaaaagcctttagaagtgaataactaatcacttccaaagccgttagttattcactgggtatactcgttagttattcactcgacaagccgcaagttattcacttcagaaggcaaaagtaggagattttacctttcatcccccggatacttccgttggtcacaataatttgattggatattcctgctgatgtaattttgatataaaaacgacatgagcaggaatctttttataatagttctattgataattacccctttttgtggttggggacaggtcgatacgatagcggaccagaagttacaggaggtggtgataatggctaagctccctacggtagagatgaaatcggggaagatgacttataggctggatgcctctatcacccaaagccaagggaatgtctacgacgtgttgaccagtttgccgggagtcgtgatacaaaatgatggcactattttcttgaatggtcaaaacggagcgaatatcttgatggatggtaagccgacctatttatcggggcaagatcttgtcaacctcttaaaatcgactcctgcctccattacggataagattgatttgattacgcatccctcggcacgttacgacgctagtggaaactccggtattatcgatatacgtacgaagaagatattgcgaaggggaatgaacctttcggtaaacggtagttatgaccaaggtaaatatggagagggtttcgcttctactaccctgaatctgcgaacgaataagctcaacttctatctctcttattcctattcccggaagaatgattacgatgatctgtatgtggagagaaactatctggaaggttggcggccggaaggggagaccgggcagatgacgcaatcttcctatcgaacttggaagaatacatcaaactattatcgtttcgggatcgattatcaaatgtcggataagactacgatcgggttttcgacggatggtaatctggcgggtaacaaggttgagggagatatgaactcatccattcctaagcgatctccgcaaaccggaggttcgcttcgcaccttgaacgatcagaatcgttcacaggataattttacggctgttttaagtttaacacatacctttaactctgatggtggggtcttggatgcctctatggattacttgcgttatcgatacgaggaagaccaatatttgaatagccaagataccttgtttggggatatggatggaggaatccatttatactccggacaagcgaatctggtgtggcctttctcgaaatccttcacgttccatgcgggcgccaagacctctttcgtctctatcaataataacgctgattataatcggctacaaggcgactcttggcagtcggaccatgacttgagttgtgattttcagtatgacgagaatataaacgcaggctatatacagcttgacgccaaattctcttcggtaagtctggaggcaggtcttcgtctggagaatacccgtatagagggcgaacagtcgggtaacgcttatcaaagagactcctcctttaccaatcattatacacatttattcccaacgctttctgttcagtatgccttgaggaatgggaatagtctgtcgcttacttatggcaaacggattgtccgtccgaattaccgggacctgaatccgtttgtatatatccacgatgagtatacgtatgataaaggtaacaccttattacgcccggaattatccgataatctggaactggcctatatacatggcgatttattccgggtggggcttgctttcaattatacgaaggatgtaattatcaagagctatttggatcaagggaactatgtcgtttatgtctcaccggaaaatctctcttcccgcgtcagcgtaggtccccggctcagtacctcccaattaccgctaacctcattttggaacgtgaacgtcagcgcatccttgatctataaccggtatcgtttaccggagaattatcaagtaaaggtgaataagagatggacaccgaatatcgggatctcgaatcagtttaactttgcccggacttggagcgctgaacttatcggtttctataatgggaaaatggcggcgggacaagctacgatctatccgttatggcaaataaatgccggtatccagaagaagatatggaaaggtcggggaacgatccagttattcgcacgggatattttccattcgaatgtatcgagaatgagcgtgatgactcccacccagcacgcttttataaaagagcggatgaaccggacggtagtcggtatttcattgacctatcgtataaatcgtggtttggaggtgaaagaatctcgccggaagcatagtgtagatgaaagtaaaagaataaatttgtgaaacctctagacaaatggtttatgaaaaagatatataagtgggtatatgccatgatttttgcggtctctttgtattcttgtatccgctgggtaacggattatacgaaagaaggacactattggacacagtccttggggaatagtatcttagaaatcgtgatccttgcttttgtctcttatttgttttttatttatttcagatggcagatcgagaagagccgaagagcgaaagaaccgaatagatggaaatttgtttggagatcgtatggaatgcctttcttattgattatattgggtgtgaatgctacgttggcaataacccgtatatttaccggtgatgctttccatatggacgatataataatcgcgaacgtgatagggtgtttgtttgcgtttatggtctataatgttcagcgagctcaagtattggataaagattacgccgagcagcgtatccaactggaaaagatcaagaatgatcaattacagacggaattgaagttcttgaaatcccaatatcatcctcacttcttgtttaatgcgctcaataccgtttatttccagattgatgaaagtaacaaggcgcctcgtcgcacgttagagatgatatccgaactcttgcgttaccaactgtatggcggtaatcagaaggtcagtatcctacaagaaattgattatttgaaaacttatatagctttgcgtaagcttcgtatgagtgaacgcctgcggttgcgtgtagagtttccgcccgaattgaatgaactgaatatttatccgttactcttcctcccgttggtagagaacgcttttaaatacgtaggtggcgattatcaattggatattatcatgaaatgggaaaataaccggatcagtttgtttatacgaaactccatccccgagctttcagcggaggacgaagcgttgcgtaaatcggtggataaacggcaacgtaaaggcatcggtctggtaaatttacgccgccgattatctttgttgtatcccaataagcaccgtttggaaacccggaaagaagagactgagttcgtagcggaattaatgattgaaatagaagatatatgacaataacctgcgtgataacagatgatgagccgatggcccgtaaaggattgcaatcgtatgtggagcgagtggattttctctccttgaccggtgtatgtgaggacgctatccaattaaataccctgttgaaaactcagcagccggatttacttttgttagatatcgagatgccttatctttccggtttggatttattggcgaccttaaaccagcctcccaaagtgatcgttacttccgcttatgagcaatatgccttgaaagggtatgagctggatgtcgtggattatttgctgaagcctatttcctttgagcgtttcttaaaaggcgtgaataaggtgcacgacctgttggctcgggagaatacgccggatgcggatgcctcgttcttcgtgaaaagcgagaagcaaatgcgtaagatctacctaagagatatcttatttgtagaggcgttggaaaattatgttagtatctatactacttccggtagagtattgacccattcaaccttgaagcggatcggggaatccctacccgatgatcaatttctccaaacgcataaatcgtatataattaatgcggatcgtgtcgatttggtagaagggaatagattacgtatcgaatcctatcaaatcccgatcgcccgtaatctcagagatgttgtatttaagcgtatccttaagaatacgttgtaattaccaatttattgtatttatacgaatttcgttcttcaggcgtttttgtagtaaactaaatacggtaagttatgaagatcaaaagttgtgcatggttggtttgtcttattttgtgtttgcctataatgatgaaggcgcaggttctgaaaatagagaatggtatggctttctcttctttggtgaatgaaggtgaggacctttttgataagtctttgtcatcgtatcaaatgtctataggattggattgtttggatcagggttggtatgcattgtcaagtaatgtgggttacttacgtaaaggtggaagttttgatttctatgaggctacagatccgggactcaatatgctgaagaggaatatgaaatacatgtttgattatatcaccttgaatactacttttcgagtaaagactctttcggatagtggttggaatttctacgcaggcgtcggacctcgtgttgatgtaaatgtgaagcgtcatatttctttaggcgatatggattctttgtttcccgagcagacagctcctgccgtgaaccggattattgtcggattaaaatgtgagaccggcgttaattataatttcgatcgttatttgttgggactaaacgtcagttatcttccgagttttataaagcctaataaagacttcattgcccatgatcgaaccttcacggttgggattttactcggatataggttataaagcgatagagacgcggcatatgccgcgtctctacaactggggtattttgttatttgaataacattggggcgaattttgtgaggtagatgcgccagtttttccagatatggccgccgtcgctctcgtagtattcgtatttgtagccgttatcgtctagtttcttgcgatagtctacgttgtttttgtataagaagtcggtcttgccgatagcgatccagtataatttcggatgcttgccgaattgtactttcagcttctcatccatattctggtagatgggagattcggagccttcacgggggaggatagcggcagagaataatcccacgtaatcgaacatatcaggatattgcttagatatatgcaaagaatggaaaccgcccatggaaagtccggctatcgcacggctggatttctttttttccacacggtaattgctctcgataaacttaatgacatccgggaagctgctttccatgctaccctccatggttttaggtagttgcatattcggcttaactaaacctaggctggattctcccggagcggcctcttgatccgcgtttccgtttgtcataaccacgatcatcggtttagccttgccttgggcgattaggttatccatgatctgggccgtacgtcctaaggcgatccaagcttcctcgtcgccacccatgccatgtaagaggtagaataccggatattttttgccacttgtctcatagccagccggcgtataaacggtaatacggcgagtctttcccaatgtcgggctctcataccaacggcgggcgaccgttccgtgaggaacatcattaacgctgtataaatcaccctgtccacccttaatgataaagatattcgtaacggatgccacgtcacggttcagatagacattgttcggatctgtagtctttaatccgtcgacaataaaggagtagctatataattcggagggaagaggttccggtgtggtatattcccaaacgccttctttaccttcctttaaatcaacggtaccgggtacatccactaaaccgaactgagtctccatcttctgtgtgggaaggaaatctcctgttacctgcaccttgatcgctttgggtgccatgaaccggaaggttacggtgttatccggatgaatctccggagagatgatgttctgactaccccaaagggcttgttgggcgaacgtgatcacgctgatcagcatgaatacggccaagattgataatcttttcataatgataaatttattaatggtattactgaggtctaaagatttttacaaatgtaatgaataatctgttacatgagcaataaataggctcgataatgtgtgtctttcgtgacggggcataatgagaggtagccttcttgaatccttccattcgcaaagcgaagtggataagtctcagacatgaggcggtgtttctcgagagcttctccggcttccttctcgtaagaaacccggtaatcgccaacagccctaggcgctacataatgctggaatagacgtaaagcgaccattcccatcgtgtaccgcatattgatctcaatgcagggatgaatagcgaaagatccatccttttgtctataggccagcatatccacacctatacagcccgcgtaagtagatccgtacacttcttgtaatacagagcgtaccgcctcttggatgcgggaataggtttcttcgcccgtgaatcgggtgatgcgagagagcatggtggattgttcctctaggatgttgcctgtataggagcctcgctcctcggtattgaaaacggataatccctcgtaacggacagtaccttgcccgtcggaataaaattccatggcgaaatcctgtactttgtctaatccgctttcgatactgatcattccttgtttgttgaatgcgccctctatccagtttttcgtttttgtatccggttttcgtttctctacccatagcaatccccgtccggaagaggaatagggtgtttttaatacgaagggagcgttgcataagatcatgtatctctccacctcccggattttcgtgcagaaacgaggcgctaccggaatagggagatcgggtaggagggcctgtatcttttccagacattccgccgccgtttgcctaccggtaaggcgaaaataatcctctttccaagtcgggacggatagccggacttttgccttgtccctcaactgctcgaataaatgaagactatgcggggaaagtccccacggggccgcgtccataggagagaggtagggagcgtttttcgccagcatcgcttttgttacaggtataggagccgggtgtaggtctttgggcaaatgggcgaaaaacggaggggttgccttactatcttccagatagacaaaatcatcctcttccgcataccaaaccggcagcagtgccaagtctttttgcattttacggacatttgtcggtgccgtgtagttctgtgtccctaaaagtacggccgtctcgtggccgggattgaaataatgtatccgtgacataaaagcgtaaaaacaacaaagccgtctttttaaaggacggctttgctcgggtttatgagattgttattccagattctcgtcgatggcatcgatcttcttgaccgttaaagccatatcctctttcagcttttcgatcttgcgttccatttctttcagtaaaccgccgccgcccttggaggaaatgcttaggaagccgatgttgttttcgtaagtctgaagctcgttcttcatgcgctcgtacatacgcatcaacttatcacgttcgctgaacaaacggcctttacctctttcgccgctggtcatctcgtttaggttgttgcggaacgactgcatcttgcgatcgttctggtctaccttcaagcgatcgaattgttggtcaaccgcctcgtgatattccttgtagatcttatctttctccttgaacggtacgaaaccgatcgtgttccattccgccatataagacttcaaggttgcgatagcctcatcatgtccaaggctctcgtccatgcccttgatcttagcgatcagctctttcttagcggccaagttggtctgctctatgctcttttgggaaacaacgttcttattcttttgctcgaagaaataatcacaagccgagataaaacgtttccagacagcgtcggaatgcttacgggctaccggtccgatcgtcttccattctttctgcaaagcgatcattttatccgtcgtatccttccagtcagtactatccttcaaagcctcggctttctcacataacgcacgtttagcgtcgaggtttttctccatatcgctcttgatcgccttgtagaactcgcttttcttctcgaagtagacatcgcaagcggcacggaaacgttcgaatatctttacattatattttttcggagcgaaaccaatcgtcttccatttctcttgcaagccgattacctccttattcttttcttcccaatccttaaacgatttcaacgcactgaaatcaatcgcctcgatttgttcgcaaatcacggtcttcgcatccagattctcctgctctttcgctttcagtttctcgaagtgctcttggtgacgcttattgatcacggttgaggcagctttgaagcgagcccataaatcctcacgcaactctttcgccaccggcccgatctcacgccattgctggtgcagcttctgaagctggtggaaagcggagataacatccgactcattacctagtttctctacggtttcgcacaaggcggtcttcaattccagattcttcttgaagtcgtaatcacggaactgattgtttatcttgataatatcatagaatttctcggtgtagatctgatagttcttccaaagctcgttcacgtgctcttggggaacggccttcacctctttccatctttgttggatgtccttgaaagagttgtataatttattgaaatcatcttggctttcacaaagctctttcaactggtcgattaactgcaatttcaaagcgtagttagcggcctttacacgctcttcctcggcgaggatagcggctcttttctctttataagaagtgagcaaatccttgatcttgttctcggtttcgtcagcgggagctgtaaaatccttttcttcgccaccatcagcgatgaattccttcttgagctcttccacctcgttacgacggatcttgtagtaagcctgtttcaaagcctctacttctccacgggaagtctctacggaagtctcaacaagttcggttaacttagcgagaatttcttctttggttaatttacctgcggcaatagcagcgtctgcctccgctgtatcgttggcttcaacgtctgcggtagcatcgatttccggcgtctcaaccggttttttagtttcttccaatttcccggcttcttccggcaaattagtctcaagagtgtccttcatatacaatcgcttttaagaaaaggataaatacattcctatatcaagtcacaaattaaactaaatatttttggattacagcatttcggggaaattatttatctaaaaagtcattttggatactaatagatgttaaggttggcctatttctcttgattccggttgtagagacggggcatgccccgtctcccaccgtctacttatactatttaatcttatttatcccaagaaggaaatcaatacgccggcagctaccgccgagccgatcactcccgagatattactagccatgcaatattgcaagacatggttcttcggatcatattgcaacgcgatctcattcgccacacgagaggccattggcacggcgcttaaacccgtggctccgataagcggattgattttcttcttagtgaacaaattgaaaatcttaacgaagaagatacctccggcgatagacaaggcgaatgccaagaaaccgccgattacgataccgattgttgttaggttcaagaacgcttccgtggtcatggttgccccgacggataatccgaggaagatcgtggctgcgttcatgatactgttggaagcggcatcgaacagacggaacgtattggttccgatctcttttacaagattaccgaacatcaacataccgatcaaaggaacggagctgggaacaaacagggcgactacggtagttaccacgatcgggaagataatcttcaatacacgcaaattcttgatctccatgttagaagggtatttcttctcttgttccttcatgttgatctgtaattctttcttagaacacagtagcttaacgaccaacgggatgataaccggtaccaaagccatgtaagaataagcggcgatagcgatcgggcctagcaaatgcggagccaatttaatggtagtgaagatagccgtcgggccatcggcgccaccgataatacctaaagacgctgcctcttttggtgtgaatcccatcaagatcgctaccaaaagcaccgtgaagattcccaattgagccgcggcgccgaaaatggataggcgaaggttacggagcatcggaccgaagtcggtcaacgcaccgacacccatgaagataatcggcggcaagaagcccgtcttgatcaacatataatagatgaagttcatcaagccaagctcgtgtgcgatatcatgcagcggcatttcccagatgtttctcatcacgccgtgtacattaaccaacccattctcatccgcttgaatcactcccatatcgcctccggggaaattggcgagcaatacgccgaatgcgataggcacgagcaatagcggctcgtattgtttcttgataccgaggtagagcaatacgaacgctatggcatacatgatcaagaactgcggttcagcaatgatattgctgaacgcagtcatctcatataagttttgaaatatctcgttcattattgaatcgtcattaatacatcatcctcagatacggcatcaccggaagacaggcagatcgccgtgatcgttcccccgaactcggcacgtacggcattgtatgttttcatggcttccacgtagcaaaggacatccccttctttcactacgtcgcccaccttcaccggggtatcggaagcgttctttactaggaagaatttaccttccagcggagaaagcacctctttcccagcgcctgcgggaacgtttgttacctctggggctgtcggggcgggagccactgtcggtttaacttccggagttgagctgttggtatcaccaaaagcgacggtcacatggtaagcctgtccgtttacatctacggtcatgacttgcggagtcgtcggcatcgttaatgcagcggcaggtgccggagccggtgcagcaggagtggcgggtaccgtcggtttaccggcgttcgctttctctgccttacgttttgccacgtctgccttaaactcgaccttggcctttccagagcgatatgcctcgtattgagcggggtgcatggcgtattcgaagagttcttcctcgtcctcgccaacttcccattgtttctcgttcatcaacttgcggtacttatccaacgcgtccgggtaattgtcttgaggattaccttcgaagaacttacgtccctcggcttgcgccttctcgataatctcgggagccaacggacctgggagtcgtccggcttttccaaggatcatatcccagatatcatcggcgatcatgctccagcgggctttccccttctccatctgcatgacgttcatcaaggctaggttcttcacgtattggctgaatggagttaccaatggaggataaccgacacgcggccatacgtaagctacctcgtcgaacaacttgatcaataactggtcttgagacatcaggggtttgttgttctttatattgctcttgttgatcgtctctaggttcttctcaaggtctgccatcaagctacccatcataccgcccggaagtcccggtccgatcagcaaggaattcatcaaccggttcttcgggctgatatacaatcccaagaaatcatccatgaattcttgaaccaaggcacgaaccttcatataagcctccatattgatctcgggcaccttataaccggcatccttcaacatagcctgtacggtcagcaagtccgcgtgccctgtaccccaagaaagcggctccatacctacgtcgatatagtcgcaacccgcgttacaaacctccatgatggaagctacgttaaagccgggaccggcatggctatgatattggatagggatctctggatatttttccttgatattggctacgatacggcctaatgtgtacggacgtccgataccggccatatccttgatacaaatctcatccgctccgagttcgatcaactcgaatgccatcttggtataatactcaaccgtatgtaccggagaatgcgtgatacacaaggagcattgtgagatcataccggcctcttttgcgtatttaatagatggggcgatattccgtacgtcgttcaggccgcagaacgtgcgggcgatatccgttccttgcgctttctttaccttataaaatagctgacgtacatcgtcgggtaccgggctcatgcgaaggccgtttaacgcacggtccaacatatgcgtctgaatgcctgccgcatggaaaggttttgtccattcacggaccgctttattaggattctcgccgaataataagttgacttgttcaaatcctccgccattcgtttccacccgggcgaaacagcccatctcgataattgccggagcgactctggttagttggtctacggtcgggacatactttccggcggattgccacatgtctctgaagaccaaactgaatttgatttctcttttcatgatattaatatgtattatttatactttctcaattttgataactttcccctgtccacgggtcacggcactgattgccgatacgatggcggctgtctcctgtccggaaaggctaccgatcgcggtggtttgcgttggagtggccgtttgtacccgaacggctgccgctactggtttcttcgctatgatctcttccggcgcgtatttattcaccaagacgataagtcctttccccagatagataacgatcaaaaggatagcaaatacggtggtcattccaactaccattaacaaaagtcctgtctctatattctccatattctatatttgtggctagcttaaaaggtttctacaaaggattgagcaactttcagccaaattaaaaacaatcgcaaaattataaaatactggaaaacgatctgttacattttaattaaaaaaatgaaaataaataagcgaaacggccttttcggtgaatgattgtcagcttgaaaaaacacgtacgtgttttttccgatgcttgtacggctgaaaattcaaatatattaccgtaactttgcggtggaactctaataatgtagaactataataattaaggaataagaccatgggaaatttctttacatctttattctcttcttccaaaccggccgaagcgacggaggataaggcgaagaacgagcagaagaactttgatatcttgaaatacgacggcgtacgtgcccagaagatgggaaaacttgcttatgcgatcaaatgctttacggaggcactgaatatacaggaggattttgagacgatgagctatctcgtttccgcttatacgatggcgaacgatctagggaaagccgaggacgtgttgaaccggatggttgagatggagccggatcatatcgctacccgcttgactcgcgttaacttgttgtttatgttggataaggatgcggaggtcataaccgattgtttgcacgtgatcgagctagagccttctaatcatgtcgcttatttcatgatggcaaaagcgaagaaagcgacgaatgacgtatttggcgctatcgccgacctgacgaggtcgatcgccttgaaggaggatttcgccgatgcttatttatcgcgtgcggagattcttttaggactgggacaagctaaagaggcgctgcccgatgtggagaaagcgatcgggatcgtgccggaggaggaaagttcttatttattgagaggacgtattcatatggctttaggggatatcgaggctgcgaattctgatttccagcaggccctagatctaaatccgtttaatgaggacgcttgtatcttatctggtcagttactgatcgagcaaaagaaatatgacgaggcgatcgctttttttgacgaggcgatcgagacgaatccgtcttttgccaaggcttatagtgagcgtgggcgagccaagaatctgaaaggtgataagaccggtgcgttcgaggacttgaagaaatctttggaactgaatccagaaggcgaagaggcccagaagatgaacggacagcattcgaatttcgataatatgtataaagggggaatcttttgatcaaggtaaccactttttcaatcccattggatacctctagttgtagagacgtagcgtactacgtctcatcccttcaaaatggtaacttaaagtaaggacatactacattccaagacaaattccatacaataagtatatgaatgatatggttctgtaagttattggacattagtgtcttaaaaatacgattgtgtttttcgcaaaagacgtacgtgtttttttgaaaagtcgtaaatgtttttcgagaaacacgtacgactttttaccgaatcattcgatagagaacaagagcatacatagaaatatacgataagcctcccttatcactggatcttctcgtatgaaacagtacatcaaaaaatctctggaaacaagtttatattttttctcagcgtaggtatctctatcgaaatgataggattctctatcgtttatttcagtaagcctcaaattgctagttttaccccttaaagttgaaagttccgcctattccctacattaatgtatccatctaattttgtccgtgtaaaaagttcacaagcttgattttggaaacttagtcccgataggactatttaatctagccctattattaaatccttatattataatctcttatataaatccatcccctttagagaagaacttatgaaaatcatccttacctgttttcttgtagggtaaagagttgatactttcttgtatatcctctttacttaagcctgtttaaagtatttagtcctatcggaactaaaacgatccttatattctaaacaacgaggaataagttaaacgaataaaatatagggacatgaaaataaagacaataatctcaagtatttgcttgatgctattagcagtcgcttgctcgatggaggatgacgtgctgagggacatggagataggagattcgggaaatgttgagatagagatgggggaggccgcttttgttcttaagacttctctttcttctttggagacaaaatccttatctgatgctggaacattacctgcttctatggatgaggcagagattaataattgtacgttgatattttttgagggcacacaagtcagttccataatggaagggttgtttgtgaataaggagaattatatcgttaaaacgaaagacggaacgaaagatgattgggctaaagtgattttaaaagtgaaaaagcctagtccttattccgtgatggtaatcgctaatagctcgaagtcgtttgcgggttgccaatcggaaaataatataaaggatataatacaggatgataaggatgctttggtaaaagttgggaaaatggatatcagttttgatactgactttgctggctatccaacaattgcggaggcattgggaaagcctttagaaataggcacaatacctctttctcaactaacagctcgaatagaacttgcggaatttaatgtttcaggttttcaaggagcatctgttaaagagaaggttactgttacaggagtggatctgttaaatttgaatcctgagagttatacgataaatgagcaaactcataaaaatgcgacttatttgtctgagagtaaaacgtgtaatgtggaggtctataatggggtatcggatcttccgtcaacttattcttttgtagataataagaatctattgtctttttattctttccggaatctggcgaaggcagagagtgatcaagtaaaaatgcaggttcggttcaaaataggaaatagcaatgaggaaagaactacgaggccgtttgtgatcaataaggaaggaaatatcttacatggcgttaaatccggatatgtttatcgcttggttgtcaatatgactattattggagataaggtcgagacagaactgctttgctatacaagagattggttgaataataccatatccattcctatggaagataattgtaaacgggtaaaataaaaatacaagattatgaaaataaggaatatattatcagtgctgtttgttggactgcttttcacgagctgtaactcggaagaagaagttcagcgaggaaatgaggacgggcgggatatctcattctctatgactcttactttgggagaagtgacagcgatgacgaaagctggaggggatatcgctgaagggtatacatattcgacagaggatgaggtaaaagtgaataatgttgtggtcgctatatttaatgaggcgaatggaactgtgggtgagtgcttggagtacaagtctgtagcgtttgacgggggaattcccaattctaccgtaacgattgatggaaaaacattgattgcttataaaattgataatatacaagcaaagacaggtaaggttcgtatcgtagcgattgcgaattcaacgcattatgaggacttggctagattgggaacgactacttatgagaacctgaaaggtttgtcggaaaccgtttcaggtggaacttttgatgcttcaaatttggtaaaggtcggggagttggctgcgtatgacctaaatacggctgtgacaagtatacctgttccgatgacacaattagcggcacgcatcgatatgaagtttacggtagatgaagagccggagactgtgtctacaacagatgatacaaaagtaaccaaccagtggttctatactgtaactaaacttacggtcaagaatatcaatcagaaatcagatttaatattgcttggtcgagataatcaatatgatgatacttactctacggcaaaggatattacattgcaaaatggcgttgcgttacctttttatacctatgagaagttgaacacgacgttaaccccattgtctatatatgtaacgggtgatttacaaaagatacaggtcacgactacctttaatgaggatatgactattcaaaatgtaacgaagggaagtattatagaggaagagaaagatcattcttataaatatgaggattttaatcctacgacagcgcttgaaggatgtacgacaaatggtatcatacatggtaatagatatgagcttacaggtaaaatatccatgaagacacaacgaatcaactttacggtatctacaactccgtgggaaggtgtggaaaagtttgtcgtggatgtggttattgcggatttgaagtatttgttcgtgagggagactaaggtggtgatggcgaatatcactgagtataagatagagtttgcttctagctcgaatattacgattgatcaaccatcttatgcgacttatgaggagtattatttggtaaatggaaaaataacaaagagagatggtacgtattaccctaatagttattattacagttggactaatgataataagcacaaacaagatcaatatcctaagataagcgcagaagcaggaaaacaaggctccattattattacgagtaaattacctgtaaattattttccaaagcaatttgtttttggtgttcataatgcagaggacttgaaagtatcaggaattatcgtagatcaatatccacctcaatatctggaaggaaaagtttcgaaagatgctggtccagcagattctcctgatggggatacaaaccctaatatctttacgataacagtcaaagctgcagggaatctgataattggagatcctagtactataaaaaatggagtccgggtgactaaagacgacgctttctctgcggaattagtatctccaaaatttgtagtagcctcaagatttggtgctgtaagtacaggtacttatacatattccaaagcggtagaacgttgtaaaaaatattgggagaggttagaggatggtacctattatgaggctggcacatggagggttcctactttagctgagttagagtttatgaatacagtacaagacgcttctcctgcggtaaactatttgtttaatacaaacggtacttattggtgtgcaatgccgtattggtattatgactttggggcaaataaacgtaatcagtttactaataatgcctctagtcaaaaagctgacggtattcgttgtgtaagagatttatattaaagatgtttattaatgatttaaatagagatttttatgataaagaaattatatagcctattttccatattactgttgctcgcttcatgtgcgacagaggaaatagaacaaatagaaattcaaccgacagatggatcaatggtttctctttcattctctgtagatgctccgaatgctcttgagattacgaaagcgaccggggatgtggagaaaggtgttgagtccttatatctatatacatttaatgaggatggagagtttatctctccagttgtagaggctgttgtttctggcaatggatatacggcttctatctcaaaagagacccgtaccatccattttgtcgccaatgatggaacgttaaccccttccctagaaagcggaatggcctcgttaggaacagataagcaaatcttttggggaaagagaacttttagtgaaattcctgcgaaaaatataagcaataatctagaagatgctggtaacaacaatgttgaactactacgaaactgggccaaaataacgctgaatctctcatcggaggcagctgtgaaattgaaaaatgtttcttatctcatttataatgaatcacagttggcatctatcggttataaagatgcgggaaagttgaatattccaaatcaagatttttatgcgccccagaatgagccagatgctagtaaatatgcgaagccgggtgaatctgtgtatacttttgaacattataatcaagataagaaagcgacttttgttattattaaggcgcaatttgatggtagcgagacctatacatattataagattgatcttgccgtaaaggatgagaatgataaggtaactcgtgtttatgatgtcgttcgtaattatgcctttaatataacggtcaagagcgtttccagaaaaggagctacgtgggctgaggttatagatgaaaatgtgatagcggataataatatcacggcctcggctattatggaaaagtatccgaatataacttatgatggcgaggccttgaatgttacaaagacgacattcgtttttacgggctcttctaacacattgtcgatgactgcgacatatgcgggaacagggcagttgagtgtggttccgggtgagggaatgtcggatgtcgtagatggtaacttaagttatccttcttggataccttctggcaatcagacgataacgattacagccaatataaagccggctcctgactccggtgagaagatagcgtatttctacgtggtaggaggtaatttgcagcgtaagattaaattggtcttacgtcccccttatgactttattaatccgagatttgaagacgtgaaggaggggacgggtacaaatgaaattgccgcaggtcagaagcaagatgcttatctgaaattctcgataccggaagatattgatgaatccttattccccattgaatataagatatatactaaaaaactgtatgcagtagaacccggtgttcgtttggaaacgaccggagcgagcgattggtactacgtctatacggatcagatatttagtcctgaagagaaggttattcattttaaaacaaatacagcaaatgatgatgaagatgatgttattttaaaggctgatttattcaatcctgtttctgatttgagttatactagacctgaaaaagttaaagagacgaaaactttctatttgcaatgtcgaagaaatggaagcaatgtgggaagtaatgtaacgatcacttattccatatcaagtggtggaggagcagcaattagaactaataatagctctaaaataatattggataaagtatccgtgtatgcagatgatgaaataacgtttacacacacatcttggggaggtacgtatactgcgaaaatgtctgtatctgatttggcgaaaagtagtaccagtaattatgtatttgtggatatgagataataataacgggttcccatccatcatgtgaataatggatgcggggagcgtgcagcacacaatggattgaatttgttttacacgtaggctgcacctcctccccggccctttacctcatatagcattcgtgcttcatcgatgccattcattccgtaaggagatgggcggcatcgctttcttcatttgctgatgaagttaacttgctttggtctgagatcaaaggttcttgcgtaaaaaattgcgcaaccctttgtttattaaaaaaaaggctctatctttgcagcccgaataagtatgcgaataataataaataatatagaaagatgaaaagaacattccaaccttccaacagaaaaagaaagaacaagcatggcttccgttctagaatggctaccgctaatggccgtagagtattagcttctcgtcgtgctaaaggcagagctaaattaacggtatctgacgaatacaacggataattagtcacgttctaaagatttataaagaaagtagaggttttttcctaaaaagcctttactttctttgtttttgtagtattgttctggtgggtattggtctatatgccgttttttttctacttttgaaccgcctacaaatacatacgtgaaatgagtaacttttttgtaaaactgataaagaatccgtttgtcatcaatctcttgttggtgatagtcgtgtcgtgcggcgttgtttatggcgtactggcgtggctggattcttatacccgccataatcaagcggtggtcgttccggacgtgaaaggaatgaagctagaggacgccgccgagtttttcgggaataataagctacgctataacgtgatcgattccgtattctcgaaagatgtggctccgggctccatcgtggagttggttcccggtgtcggatcgaaggtgaaagaggggcggatcgtctttgttacgattaacgcattgacctcccagatggccgtgataccggaggtggaagacttatctttccgtcaggcgtatgccttgctgcgggcccgtggcttctcgtcggtcgagatagagtatgtgccgggcgattataaagatttggcgatgggggtggagttaaacgggcgtaccttgctcaaaggggaacatgtaccgttgaccgctcatctggtattgaaagtaagcagtggcgatccgaatatgcttcccgactcattggctttggatagtattccggtagaaccattggatagtgatatagaaaactggttttaagggaatggacgagtttttggacgatatggatgatgaacaggtagacgacctgttgatgccggaagaagacgaaacatcgtcgagccagatgtatgagcatttccgcttcgtagcggacaaggggcaatccctgctccgggtggataagttcttggtagaccgtatgatgggcgctacccgtaaccgcatccaattggcggctgaggcgggttgcatcttggtgaacgataagccggtgaaaagtaattaccgggtgaaacctttggatgtggtttctatcgtgatggatcgcccacgccgggaactggagattatccccgaagatatccctttgaatatagtatatgaggacgatgatttgctggtggtgaataagccggcaggcttggtcgtacatcccggccacggtaattatactggtacattggtgaatgccttggcttattatttgaaggatgatccctattatgatccttccgatcctcgtttaggcttggtacaccgtatcgataaggatacgtcgggcttattggtggtggctaaacgcccggaggccaagagtaacctgagcctgcagttcttcaacaagacaaccaaacgtaaataccgtgccttggtatggggcatcgttcaagaggatgaggggcgtatcgagggaaatatcggtcgtgaccctcgtgaccgtatgcaaatgaccgtcttcccggaaggcgatcaaggcaagaccgccgtcacccattacaccgtgttggaacgcttgggctacgtgagcttggtggagtgccgtctggagacggggcgcacgcaccagatccgtgtacatatgaaatatatcggtcatacgcttttcaacgatgagcggtatggcggacatgatatcttgaaaggaacaacttttactaaatataaacagttcgtgcaaaactgtttcgctatttgtccacgtcaggccttgcatgctaagacgttggggttcgttcatcctactacgggagaggagatgtttttcgattctgagattccttccgatatgcagcagctgatcgacagatggcgtgtatatgcgaacactaaagaattgtaaaaatgaaaaagaacatcgctatcgtagcagggggagattcctccgagatcgttatttcattaaaaagtgcggacggaatctactcttttattgataaagacaaatataatttatatattgccatcgttaagagggatgagtgggcggttatacttcctagcggggaacatacaccaattgataagaatgattttagcttcaaggagaatggcgtgacgaggcattttgacttcgcttatataacgatacatggtactccgggcgaggacggacgtttgcaaggatatttcgatatgatcggtatgccttactcgtcttgcgggatgctggtgagcgctttgacattcaataaatacgtatgtaatcattacttgaaagactttggtgtaaaaattgccgcgtccattcatttattcaagggagagactattacggacgaagaagtcgtgactcgtttgggtttgcctattttcgtgaaaccaaacgatgggggtagtagttttggcgtgacgaaggtgaaagaggtctccgctatccagcccgctatcgctaaggcgtttggggaaggacgtgaggtgattctcgagcgctttatcgatggaacggaagtgacatgcggttgctataaggtggagggtaaagaggttgtcttccctttgaccgaggtggttacgaataacgaattcttcgatttcgacgcgaagtataacggacaggtggacgagatcactccggcccgtatctccaccgagttgacggagttgatacagcgcgagacatcaaggatctacgatatattgggcgccaaaggactgattcgtgtggattatattattccggcagacggggagcctgtcttactggaaataaacacgacaccgggaatgacggctaccagctttatcccacagcaagtacgtgcggcgggattggatataaaggatgtcatgacagacattattgaagacgaactcaaaaacagaaaaacaaaatgaatagatatggatacagaaacagtttcccctaatttcgacgacatccgtccgctgaacaacagtgaggtgaaggacgcgattgaaaaattggtcgccaatgaggatttcgagcgggctttacgttacataaagccgaatttgaattgggaggaattctcagttgccatgcgtgcttgcaagacgaaggaggagtttaaatctactctggcctatgacgctgtaatgacggtggcgaaaaatactactttctcgcttactatctcagggcgtagccgtctgccgaaagataaggcggcctgtacgtttatctcgaaccatagggatatcgtattggatgcctccttcttgaacgtcatgttatatgatgtggggtatggtatgacgcaggtcgctatcggcgacaatcttttaatccgtccgtggatcgagacgttggtgcgcttgaataacagctttatcgtgaagcgtggcgtttctgttcgtcagatgttggaggtcagcaagacgctttccgcctatatccatcatgcgatcaagaatgtgaacgagtctgtatggatcgcccagcgtgagggacgtgctaaggattcggacgatcgtacgcagggcagcgtattaaaaatgttgagtatcggcggtgataaggataatctgttgttgaatttgatggacttgaatatcgtaccggtcgctatctcctacgagtttgatccttgcgatttcttgaaggcgaaagaattccagatgaagcgggatgatccggattacgtgaaatgtcagcgggatgatttgttgagcatggaaacgggtatcctgaataataagggtcgtgtccacttcacgatcacttccccgatcaatgattccttggctaaactagacaaggatatggagaagaatgagctggtaagcgctatcgcgtccgttatcgaccgggagatctataagaactatcgtttctatccttgtaattacgtagcttatgattggctgaacggtactcgccgtttccacgagcattacggaccgaaggataagaagcagttcgaggagtatatacaaggacagttggacaagatcgtccttccgaataaggatgaggcgttcttacgtaagaaactattggagatgtactccaatccgttgaagaactatttgacaactttataagttccaattgattttgatagagaggtgttgtaaaagagcggaagaagccttttacaacacctttttggttaaccgacgtatctacgttcataaatacctgcatgaatgtatgtttcttaacatacgctttcggtgacatattgtaatcccctatttcgtatctttggcatatacggtaagaaacgcttacagtatgctaatcatttaaatcagtagcagtatgaaaccggaagattacatcacccgtgaggagaagtatggtgcccacaactatcatcccctgccggtcgttctcagaagaggcgaaggcgtgttcgtgtgggacgtggaaggaaaacgttattttgatttcttgtccggatattcggcgttaagccaaggacattgccatcctaagatcgtaaaggccctgatggagcaagcggagaggcttacgctcgtgtctcgtgcctttcatgctgatatacttggtgaatacatggaatttacttgcaaattcttcggctatgacaaacttctgccgatgaatacgggagccgaggcggtagagacggccttgaagctttgccgtcggtggggatatcgtcggaaaggggttgccccggaacgtgcgaagatcgtggtttgtagcgagaatttccatggacgtacgattacgattatttccatgagtacggaccctagctcatacgccgatttcggtccttatacacccgggtttataaagataccctataataatgtggatgcgttggccgaggccctgaaagatcctgatgcagtaggcttcttggtggaaccgatccaaggtgaggctggggtagtggtgcccgacgatggttatctgcgggcttgctatgatctttgtcatcaaaagaatgtgttgtttatcgcggacgagatacagacgggtatcggccgtaccggtaagttattggcttgcgattacgaggggattcgtccggacatcttgatcttgggaaaggcgttgtccggtggggtcagtccggtctcggcggtattggcggacgatgagatcatgcttacgatcgctccgggagagcacggttctacgtatggtggaaatccgttggcggcgaaagtcgctatcgcagccttggaggtggtacgtgacgagcatttgtcggagaatgcgtttaagatgggtgagctgttccgtggtgagatggagcggattaataatcctatgataaagaaagtacggggtaagggcttgctgaacgctgtcgtgacggaacctaaagatgggaagacggcatgggacatctgtttggcgttgaaggaaaacggtttgatagccaagcctacccacgatcatatcatccgcttcacgcctcctttggtgattacggaggagcaaatgatggaagcgattggcattatacgagatacgttcgctaaattctagtgtatgaagataaatgtaataggtgttcccttgaatctgggatgtgaccgggctggcgtagagcgtgccccgaaccaccttcgggaacggggattgatgggggtgatccggaagaacgggcataaagcctttgacttgggtaatttgtatgtaccccctgttagcgaggcggataagttcgtacggggtaacagcatgaaatatctggatgcgatcgtggaggtaaatacgaatctggcggagttggtttatgatacattgcgtggaggagcgttccccttggtgattggcggggatcattcgctgggtttaggtagcgcctcgggcgtgggtaaatgttatgatgatttcggcattatctggctggacgctcatggggatatcaataccagcgagacgtcacccagtggtaatatccacgggatgcctcttagcgcattgatggggatgggaagcgaggagctggtgaatgtctacgcacccgggaacaaggtgaacccgcagaacgtattcttggtcgggacccgcagtctggatgaaggcgagtgggatttgatcgagcgggagaagctgagtgtctatacgatggagacgatccatctgaaaggtatcggcttcgttgcggaggacatcaagcggaaattgaaggaacggaagatccgcaacgtgcatttcagcatagacgtggatagcatagacccccgtttcgccccgggcacgggaacccgtgtgtgtgagggactgatgccggatgagtttaataacttcgtggatcatatgctatcgacaaacttgattaaatcgatggatctggtagagctgaatccggaattggatgtgaacgagcagactacgagcctttgtctgcagatcattgattatattaccgcccgtctataaggaatctaaattccatggtttatgataagagtgtgaaaatgaagtccccttgtcccggttcagaccggatacgaggggacttgaaaatacgatatgtctatcggtttatttcatttttcggatattggcgtaattgaagctatcgctcaagaaatcatcttcgctgaatttatagccttgagggccccagttgcccatagcgagcatggcgatcatcttcatcggattgaaaccgctcatatcgccgccggcggccgctagaggaacggactccatcagcttgcgcatggaatgtggataattctcgttgatcaccatgttgcggtataaggcaaggattccatctccttgctccttacggttccaagtcaggatatatgtaccgtcgttggcttctgctttcgcttggagatcgggtagtttggcggagttggcgtctgctatgataaaggttacgaaaccttccttgtccactttaggcatttctttgtcgtaaatagaggcatacgagtaggtctcggctgacccaaggcatatggaccagtatcgtacatcggcggtggcgtattcgcttacgcttttaggagccgtaggagggatgaaacggaaagtagctacctccccttcgttcagtttgatgcgggcgaataggtattctgccgggctgttcgggtacattaggctcagcggggcacgcatgaacgggagttgcggcaggtcggtggagaaatccatcggcggcaagttcaacgattcgtggatgttgcagacctcacgcttcgggaaatccacttcctcacctgtagtcacattgaaagcttggatagcaggcatgtccacgccgccatactcatcgccgctatattgtttcgccaagtaaagacgcatgaaaatggagaccatattgacatcttccggaaactcgcatatgttcttcatcgaagcacgtgcgctagccggtgtgttagctggaatgatatagatcgtatagccatttgatgcgtaatcgtctgtctcctttacgtaggggttgatagagctgtcgtcgggttggatatttacgtcctcgatgctggatacgtctatctgggtctcgtcgttataaaccgtgaagttaaagaagcgtgacttcgggtactttccggtcagacggaggccgatgtttggattatctttgtaagaataggtgtattcccaataatcggcatagatatcaggaaaggccagtagggtttgattgtcgccccggagcgtcttgccccattgttccttgggttccgggttgttgatttgaggggtattctcatcattgtcatcgcaagcggtgaacatacccatagtaagggctaccaacattaagtaaaaaatcttcttcatgattctgttcgttaattaatctgtttgttattaaaatgagagcgcaaaagtatctcatttccaattagggttgacctattgaaaatgaaataccttggataagaccacagaatcctaggaatggaacagctagaaggggtatccgatagcgaaatggtaacccatgccgtccttgaatttcgggatattgtaatagcctttctttccggtatcgtaagggaggtgcaggccgatacccacgtcgaaacggatgacgataaaggtgaggtcgtaacgcaggccgaagccggttcccaaggctagatccttgaggaagctaccccatttcagttgtccgccgggacgatccggatcgtttcggatcaaccagatgttgccgctgtcgaggaaggtagccccgtggaggtcgccaaggatcgggaagcggtattcgagattggcctcgaatttaagatcacccgtacggtcgatgtaagcgtatttattgttgtcgctgttctggtagtagcgtccgggaccgatgctgcggatcgtaaaggcacggatgctattcgctccgccgatgtagaattgctcgttataaggggaggtacgggcgttgccgtaactataaatagcgccggccattaatcggcctacgagatattgcttatgcccgagggcgtaattataacgtatctcggcggttcccttgatgaattgggcgaaggggttgccgagcagttccttatcctcttgattgaacttcttcccggctaacgcataaatcccatccaagacaaggcccgcttgggtaacggatgcctgccaccaaagatggttccggcgactggtaatcggggaatcatcataggtataggtatagttcatggccgggatgaattgattttgcaaactcttctttagggccttgttcacgttggtaatgctgtcgaactcatgcgtggtatgctggagcaagttgaacgtcagcttgaaaggggtgatggaatgatgagacgtggcggtaggctggaactcatacgaggcgtcaccaccgaatgccagcaacttgaagaaacgggcccggttcatctggtccgcatagaggcggaaggtggtgctggccgggaaattcatgtcccgtttgctgaatgtagggaacaatacccgtgggaaagtcagcgtggtagtcaagcctaactcataactgttgatcttggagttgctgccatccagcttgttgccggtctgccattcgtaagagccgcggagtttcacgccgaaggtctcgccccctccgaagacattccgtttggtcacgctgaaaatggcgcccggacccacttggtcgttgctcttggcggtaacgttcaactcgagctcgccgtccaatggaagatcgtagaccgtattgatccgcagatccagcgtatcttgacggcgcatggtatcacggggggaatattgcaactcggcataacggaagatacccaagcgggacagggcggtttgcgtccgttcctgcgcccgctggttgtaaagttcccccggcttgaaatataaacggttgtaaatgaccgaggggcgaacccttagcttgccctcataatggatcgtaaggtccttatagcggatcgagtccgtgggagtctcattctggtaaccgtttagccagacggatatatccccgagcttccaagggcggagggccgaggggggcaggctttccttcggggccacccgtaaggccactttcccggggttcaacaaggtatccgcttgataggtgatgaaatcgggacggaaatagtaatagccgttgttacggagcaaggacgagatgcgttcccgctcggcttgcaactggacgacattgaaattctctcctttgtggaggatacgatcgccgatcgtggcatcgatcaatgagtcggcacggtgacggatatggacgtattggatgctgtctagcgtatacggatcgttcatggtgacgctatattccagcttcgccttccggggattcttgggatcgggtacgacctcgaaagaggtctctccattgaaataaccgtattcgttcaataggttccgggctaccttgacacggacttccgggttcacggtggtgatcagcaccggtttcgacgccagcttgttgaagatccacttgccgaccttccctttcttgttcacgaaagcgttgtagacccacaggccgaaggggaagggcacccggatcgaggagcttcccagcaaggcgttgttggggggataggctagggcggcctcgacctcttccaaggcggcttcgccgggtttggtcttatcctcgttcttcacctctattttcttgataccggtatataggaccgctccctcgggaaggttcttcgtggtggagcaagaggtgagtaagaaggccagcagcccgagtagcgccagcgacgataggatcgctctttgggtagacaccccccctcgccctggggaagtatccttccctgctttgggaaggcatgtttccctgctctgggaaggcatgtttccctgctctaggagggcatccttcctaaaatatattaaaacatttttcatattcattccttttctgtttcctctttcactggtttcactttcgttttcttgaagttgaatagctccctgagatgcatcattttcttgcggagcacgataccggctccggtctccgtgatctcgccttccagcaggctctcgtagttcttgtcgtggaaaagtttgacgtaacgggagccactgctgtctaaccgatattctacggatacgttatcgatgaacggctgcgcctgtccattgttaatgttctcgccggtagagatacggccgcctagaaccacacggatacggtcattatagaatcgcttggcgaagcggaaggagtagtcggtacgggtaccacctccggcgtcgccattatcgtcgtacgtctccatgccgaagctgatatccacggatttcaaggcacttccggcgatgttgttgatctcgctttgcaagaagctggtcaaggcgtctcccatatttacgttcaccttgccgccaccaccgcctccgccgaggtacataccggtcacgagcatgctgacagccagcttcgcccgttcctccgggccttttgaggtcagttcctcctgcatcgccatgtcttccggggcggtgagggtaaattgcaaccctaggttctccagttgttgggtcagttcgatgcctacgtcgaaattcaccaagcggggcgatgattgcccggttagggtgacggacgtacggactcgctcggtagccgtaaggttcaaggtcgggtccatggggttgcccgtccattgcacgtagctaccctcttgtacgttgaactccttcaatgggatcaccgggatggagtacttgatggttcccccggatagcgtgtagcgtccgttcaagaacatatcgccttgcggggtatactggaaggaaagatcgccgccaccctccagattgatatggttggactggtcgggacttaaatccacgttcgcttgtacggcgggatcgatgtggatcgtcatcagcatgtccatgcctcccatcggcaacgggggtttacgaggcatgcgccggcgtaaggtatccgtgaaagaggtgaaggttaccatgtccgacatacggtcttgcacggtcagcggggagtctttcagcacgtaggtgatattcgtcccgcccaataattgcaagtcgcctcgcatggtcaaggcatccaacggcccgcgtacggtagaattcaggttgacgaacagctttccgtagacaaggctttcttcgtttttcttaacgttcagcagttgcaagttattcgccgttagtttaagattggcggtcatgcgggataaattgttgaaatccacttctccgttgatgataaacggattcttgttgtatgcgtaaataccatattggttgaacaagatccggttgttctttatttctatctttttatcgtcgaaacggaaggtagaacctgcggcgcctacataaacggaggcggtatcgagaatcagatatccctcggccatgggtttatcgctttgtccgctgatagcgagcgtaccatcgaggtctccgcccattttcgccatatcatccggaatgaacgggttggcgatatccaaggggaagtgcatgaactcgacagtaccgctgatatggtcggtctcgcccatctggtataaggcggtaatggcactcacctctttccggtcccggaaaaggtgcatatccacttgatggttcccctgctctaaaggtagatagactgcgttgaacatgagttcgccgacccgctcgttctcataatacagatcatcaatgttcatatccgccacgaccatgaaggccgagtcggaaggagcgtactggaaatcggcgttcaatatacctttcatcggcgggatatagctgaatgcgttggagataatcccaaggtcgatctggttcaactcggcgtggacttcctccatctcgtcactttccgcttgggagtgtatccacaaggcggcgttattatctccgctgagtcgcaggttcgcctcgatatccttcatgctgcgtaccacgacgtaattatccgggttcagcttgaaagggcggaacgctatgatcgggtcatcggggaagagatggaacttgaccccgttctgtatcttatcggcccggattccgagcaacaagccggtctcgcctttcccgtccttgaaataaaggcgggcgtcgccgaagtcataacgtatttgcccgtccagcccggcgctgaaaggttgttgctgcctgtatttattcttgatcacttgggcgctatagagtaatccgagcgaatcttggtgcatctctgcccggatggtatcgatctgcatcgtatcccgtgccagatcgtaaatggaggcatccatgcgtatacccgtttccggtgaggtataggcgttcatggcgatgctcttgaaatctacgtaataggtttggagatagttgtagatcggattgtcctgtcctgcccgtacctcaaggtacatatcggggaggagcgggcgaaggatctccagattgacagtcgagtcccgttccaattggagggtgatatcgttcgataccttagtcaacttatccgtgatgtggtgtatgcaatcattacccgtgaggatgatccctaaatccccggcgtggaaagacacacgggtggtatcgatatccgtccgggcatgcaaggtcagcgttttcggcttgaaactttgttttggggtgacgacctcccagtttcctaacgtaacgtcgatcgtgttatcttcatccagattactttctacctctgcgaagagctggaaagaggtggcgaagggatttgccattaagtgcataccctgtaaatccatgttctctacatccgctatcaacatcgctttcacctcgtgcttgtggagggtcgcgtttaaggagacatccattttcgccaacgggtatttgctaagcaagtccactttcagtaagttcttttccagagagccatcgatggatacgtctgataccgatgaggcgccatagcgtatatccgatatcttaccgtccagtttggcccatgtacgttcagagaaagggtctgtgccccggccttctgctttaacagaggcggtcagccaaaatagagagtctttaggcatgaaatgagtaggttccagactgtctatccgtaaattagcctcataagccagttttaccggattatagcgggcggtcagacctactttgcctttatcttgggtaagaacaagctcggtgcggtattcttgatttgcgactgtagcttcccccttcaactgaattcctgccggaatggcaaattgatcccgttgggaggcgggaagcatcgccagcaaaaagtccagattaccggatcgagcgtttaactgaatctcaccggttcgccggatgctatccgtcacggactccatgctacccgtgacgttcatctgaaacgctcccggcagcatgatatcgccttgtgtgatacgtatactggagaggttgccttctacgccagccgtaatagcgagaggcttgtccgggtaggctttcttgaaatcctccggaagagaacctgccgctatcaataaatcctctttccccaacgaggcgtttaacagggctttcatgctaccttgcggatgatcctcgagggagctccaagggatagtcgctgtcaatctcacttcggaatttggtgtctggagaagtagctccggtacgtctatctgttcatggtcactccggacatttcctgctaatgccgaaaccttgaggccggaacgttcttccacgaagaattccttgatgtgggcgtttatttcttttccttgatataagatggaatcgatagaagtgttcaggttcgttaaactgatatgggagaaatcgagtccttgctcgggtgccgcgtaattcccgtcataagcgaatgtagaattcgttatgtcaaagtttctcgccttatattgttccgctccaagatctacgaggccgttatttagcccggctttattaacgaaagccgtaaggcgtaaggaatccgagggcatttgtagggcgaaggctacccggtccaaactaattttatccagcttgagtacccagttcagaggtgtggaagtcgtgtcttctttcgaggttgaatcatttaatagaagggtaatggcggtatcggataaatctacggtattaaatgtagctttctcctcggacaggtctatacgatcggcgtgcaggtaaagctttcccaagaatcctttgatttccataccttcaatcatagtcccggtgttaacctttacgttccggaggtcgatcgcctctaccaatacttgcttccgcaaaagaggaagggcacgaacccgtaccgtcaagctctgtaaactcaacaaggtatcggcgggaggatttacgacctcgacacccttaaccgtaaggtctaacgggaaagatagcctaatctgctcgatcccgatttgcataccagtcacttttcctgcgtattcggtcgctttccgtaccgcgaagttttggaaaggaggtatatatagtaatatagagagtaacaataccaatgcgatcggtattaggcatatcactcctatccgtttaatccatactctcatgttgatacgtttctctttttcttatttgtttatttgcctgtttttatgacgatcgctccgttcgcgcctctcaccccgtattcacctgcgtctttcaatacttttaattccgagacatcttcaacgggaatcgtgtttagaacagataggtccatcggtataccgtctaccactactagcgggtcactaggactgtttagggaaacgctcgcacggatgcgtacggaaccatcggcgaatgttatgccactcatccttcgtagcaggcaatagagatcccggcatccggttttctgtatctcttctttattcataacgcttgagcttactattttgtttcgttccctttccataatttctttcagggcctcatccggttcaaaactacgctctgcgttgaatgtgctattctctaaagtaatggttatataattgtatccgttgactgggactttgactacatttcttgttttcttaatagtgacgaacaaggtatcattcaggttagcccccgggatggtgaatacgccatgtttgttcgttttcacggtgatcggattctgactgcctagcgtgaccggatagcgtttgattattttatcgctgatgtcacgcaatacaccgactaaagtatcattctgtgccaaaagtatttgactgctgaatgataagatgatgattgaaagataatgtattgttttcatagctcaatctttttagctgaacataacacaaagataatataatatttcttaaaggcagagttttagggcaaattcgtaataggtattatttttacgtttctatgtggtctcatttgtcgctaaaatgagattactataaatggaaatcattacatttgccaaaataaaatgaacggtatggaattagatttagcctatttgtgtaaggaggttcgagaaatagctcgtgcttctgcgacattcttaaaagaagaacgccgaaagtttgaccggaacttagtggaggaaaaaagtgctcataactatgtatcttatgtggataaagaatcagaacgacagatcatagaggctttgtctactttgctacccgaggccggttttattgcggaggaaggctctggaagtttgaccgatgaggaatattgttgggtaattgatccattggacggtacttcaaactatattcatgatatcgcgccttattgcgtgagtatcgctttaagaaatcggaaggagttattgttaggagtagtctatgaggtgtgtagggacgagtgtttctatgcagtgaaaggtggtaaggcttacttggatgggaatgagatacatgtatcggatgtctcagtactggataacgctttcattgcgttgggtttcccttataactctgatgcttatcgtccggtagccgctcatttggttgataggttgtatggttttgcgggaggtacccgtttgatgggatctgccgccgctgaactgtgttatgtggcagcaggacgttttgatgcccgtatagaagcctatttaggcccttgggacgtagccgctggtgccttgattctattgcaggccggaggaaaaatatcagatttcaatggaggagagaactgggcttcgggtgaacaggtagttgccagcaatggcaaggttcactctcttgtgttgtctttgttgccctaatactagagtaatcctgcgtattctagtgcttctgtgtgtatttaaaaggtaaaagagtttaaacttacttcttatttgcggggtgtttgatccgttttgattttcaaaacagatggaggaatacaaatacccgtaaatccttgtatgtgtctaattcagtaaaaatcaagacttttaggattagagattttacttacatttgtggaaaataaaaatgttacagagtatgaaaaacaatctatacgtcttttttctgttctttattactggactaatgtcatgtagccatcactcaggtctatatgaacatgcggaaaagataatgtcccaacatcccgatagcgttttaacattgctatcaacaatacaagatgtaaatgatctttcagaaaaggatcgtgctatgtactacctacttttgacagaagcggaagataaaacttataagaagcacgagtcagactcattaattgcaatagctacagaatattttgataagacagatgatgtgaaaagaaaagcaaaagcttggtattatagaggacgtgttgttgatgatttgaaagatgctccacgggcgcaggattattatttaaaagctttacaaaatgagatggagattactgattatgcttttcttggacgtttatataatagtatagggatgctttatacctatcaagaagtatatgaaaaagcggttctttaccaaaaaaaagctttatattgtttcgaagccctttatgattcgattgggcaatcttatgtactgagagatattggacggaacatgacagctttaaataaaatggatagtgctattttttattatgaaaaggcgttatacttttgtgatcagaagagtaaatcctctgtatatagagaattggctaatctgtatttagatattgataattattcaaaagggctagagtatattgagaaggtcttaagttctcctttaaaaaagtcaatgttagattctttttattttgtgttagggaaatattatcaaaaaactaaccaagttgattcagcgtattattatttaggatatagtagcaacagctctaggttacaaacacaagctgcagcttattatcatttagctcagttggagagattccgggaaaattggaaaggttatgcgaataatcagattagatatgaagttttaagagattctgtaaaccaaacaaagaaaacggaatcaataagacgaatagagaaaatatatgattatcataaaacagaagctaaactattacaatctgaagtcttgttgaataagttgaaagtaaagaatttaactgtgactttaattttaattataagtattgtcgtgattgtcgtgatatcagttttaggatatgtgcagatgaaaaagaaaaagttgcgtttacaagagcatagggagctattacaggctctagaaaaaaaacaccaagcagatctgactcgcattgaggaaaatgaaaaacttattagggaattagaagaaatgttgcaaaaatcatctagagcttacaatgaaaaagagaaagagttgatggctcttcaaaaaatgaagttggaaactgaaaatcagaatttaagatatgttaaaactgaaaatcggtttttaatagagagttttcagatgtctgatatttattataaattccatatgaaagaagaatggagacctaaagaagaagattggaatgaattatttaaggctttggatgaaacctttgataagtttacacgacgtttgatgactatattctcaaggttgacaacaactgagttgcgtgtttgttgtttaattaaagctaatgttcctccagtaacaattgcgatgttgatcgtaactactccaacaaatgtatcaatgataagaaagcgtctttatgagaaaatatatcctcaagaaaaaggatcttcagaaaagtttgatagatttatccgagagtatttgtagtaaatgtgcatattttgtgcaatagtagtagttgaatcactagcaaagtcattgtatgtttgttgcacaattaatacacaagatattatgaaaaatgtgaacagatttattttttgtgcaattttttttgcgttatttttagttcaatctgtatttggagatattattccaacagaaggagcttgggatgatgaacgttatcgttccgttaacacaaaccgtcctccagttgcatcaatcgaaggagacatcctttccttgagctttgaagatgctttatcaaacttgaccgtatgtgtcatgaatgatgaaggagtgaaagtctatgaagatgttgtttcttcagaggcaggtggaacttattctttctctttagcgggagaagcaaatggccagtatcaggttgtgttgttacatcggttgggacacttgaccggtagctttaccttggaataaaaaattaagaggttttgtaagaagaaagagctgttgcttctcggtaaaatgggaagcacagctcttttttatttggacaactgtaccatatacgaacctttacttgaaaacgtatctatgtacatgttttaccgctaaacgtatcattaatcagccgggagtcattctgtttattgtatatttcttgaaaataggcttcattgtagcctgctttactatccatagaaatagtgattagtattaatagaaattcaaaatactatggatactaatcggagcttggatagatacgattttattgtatgttgattattaggtgtataggtaatagtttggaaatattagacttattgtgctttttaagagatcaaatttggtgtggttgggctatttttatttccaagtggtgttatttcatgactatattataacttgaaaaattcatagttatgaaattcacaactcataactatgttttaaaaaaaacataactatgaaattttataggatttagctgttaaaatcaatatggatttcccccttgtctaagaaatgacaggacaatactattatatatgccgtttattctgtatttttgccagaaaaattagcagacatggctgaaagcaaagttgaacacctattggatagcattcattttccggaagacttgagacatttgtcacaggataagttggagcaggtatgtgccgatttgcgtcaatatattatcgatgttttgtctgagaatcctggtcacctaggtgcaagccttggtacggtagagctgacagtcgcccttcattatgtattcaataccccctatgaccgtattgtctgggatgtcgggcatcaagcttatggacataaaatacttacaggaaggaaagatattttccatacgctccgtaagtttaaaggaattagcggcttccctaatccggcggaaagcgagtatgacgcttttatcgccggacacgcttcaaattcaatctctgcggcgatgggtatgtcggtagcctcggccttgaagaaggaactggatcgccatgtgatcgccgtgattggggatggcgctatgaccggaggactcgccttcgaggggttgaataatgcgtctgccaaccctaataatttgttaattatcctgaatgataacgatatggcgatagatcatagcgtaggtggtcttagccagtatttagtggatataacgacgagtcaagcctataataaaatgagatacgatgtgtatcgaggcttaaagaagatcaagctcatcaataacgatcgccgggaaaacatcttacgttttaacaatagccttaaagcattgcttacccagcaacataatttatttgaaggcttcagcatccgttactttggtccggtggatgggcatgatgtaaattatctggtgaaggtattgaatgatataaaagatatgcaaggccctaagctgttgcacatcaaaacgaaaaaaggaaaaggctttaaacctgcggaagagtccgctacggaatggcatgctcccggaaagttcaataaggaaaccggccagcgtattatcgttcgtaaattagatgagcctcaattatatcaagacgtattcggtcatacattggtagagcttgcggagaatgatgaacgtattgtaggcgtaactccggctatgccttccggttgctcgatgacttatatgatgaaagccttcccggatcgtgcgtttgacgtgggaattgcggaaggacattccgtaactttctctgctggattagctaaggagggaatgatacctttctgcaacgtgtattcctcgtttatgcagcgtgcgtatgatatggttatccatgatgtagctttgcaaaaactacatatggtgatctgtctggatcgtgcgggattagtgggagaggatggagctacacatcatggcgtgtttgatttagcatatcttcgtccgataccgaatttggtaatcgcttccccattgaatgagttggatttacggaatttgatgtatacaggctatgccgcttttgatggcccgttcgtaattcgttaccctagaggtaagggggagatgaaagattggcgtaacgagatgcaagtattgcctataggaaaagggaaaaagttgtgtgacggggatgatatcgccgtactttctatcggaccgatcggaaacgaggtgatcaaagccatcgagatggtgaaagaagagggggtatcgatagcccattacgatatgatctacttgaaaccgttggatgaggagctgttgcatgagatcgggcagaaatataaccgtattattacggtagagaatggagtgataaaaggaggttttggtagcgctgtccttgagtttatggcagacaatggctatacgcctcatgtaaagcgtatcggagtgccggatgcgtttatcgagcatggttctataccggaactgtatcaattatgtggtatggatgccgagagcatcgcgaaacagttgaaaaaggagaattgattattgtcaattaataaaatatgaaaattgtcatagccggtgcgggagaagtaggtacacatttagcgaaaatgttatctcaagagaatcaggacatcattttgatggatccgaatgaggaacggctgaatttctcaaaatctagcatggagattctccctatggtcgggaatccgacctcgcttagagatttggaggaggcggggatcaagaaagcggacttgttcgtaagtgttactcccgaggagactaccaatgtgacggcttgtatgttggctcataatctaggagcgcatcgtacgttggcccgaatcaataactacgaatatttattacccaaaaataaagagctgttcgagaaactgggaatcaactcgatgatttaccctgagatgttggcggctaaggagatcgtgacagctgtacgccgtccgtggacacgccaatattgggagctgtttgggggagctttaattctgataggtgttaaagttcgggataattcccgtttggtgaaccgggtattggccgaattgctaaatgagcagaagctatatcatattgtcgctattaagcgaaagaacgagacgataatcccccgtggtacggaccggatagagtctggtgacatcgtgttctttacgacgacccgatctcatatagaggatgtacgcttactggccggaaagaaagatccggaagtaaagaaggttattattatgggaggaagccgtatcgctatccgtgcttgccaatatttacctaataacatccgggtaaaagtaattgaggctaataaagagaaaagtcatcgaatcgctgaggttgttcctagtaatgtcttgattataaacggagacggccgtgatactgatttgttgatgcaagaaggcatcaaggatgcgcagacttttatagctttgacggaaaattccagcacgaatatattggcatgtctggccgctaagcgtttaggtgtgtttaagacaatcgctaagattgagaatattgattatatccaattggcggaaagtatggacatcggttcggttatcaacaaaaagctgatagcggccagccatatctatcaatttcttctggatgcggatgtctctaacgtgaaatgtttgacctttgcgaatgcggatgtagcggagttggtggctcgaccggattcaaagattaccaagaaacaagtcaaggatctccgtctgccgaaagatatgactctcggtgggttgattcgtgacggtgaacctatgatgatcaagggtgatactcagatacaggcatacgatcatgttgtcgtattctgcttggatacggctatgcgtaagctggaggactactttaactagttgatagttatgttgaacgtacgttttatagtgaagatgctaggggtgatgttcatccttgagactttttttatgctggctgctactgtcgtagccttcctttatcgggggagtgatgtatatccgcttcttatttcaagcggaatcttattcgggaccggttttttgttctactctatgggctttaaggcgaatgaacactcggccggccggcgggaaggaatgttgatcgtgacattgacatggattttattctctttatttggaatgttaccattctatataggaggatatatagataatgtgaccgatgcctttttcgagaccatgtccggatttacgactacaggctctactattttaacgaatatagaagcgttgcctaaaggtatcttattctggcggagtcttacacagtggcagggaggtatcggtatggtcgtattcaccgtggctttgatgcctattttcgggggtggtgcctcgcagatgtttgatgccgaaacgcccggtataacccatgaacgttttcgtcctcgtattacgcaagtcgctaaacgcctgtggggggtgtatgtttttctgacactttttttagtcggccttttatgggctggtccgatgaatttgtatgatgcggtaaatcatgcgttcacggctatatctactggtggatattcaaccaaaaacgcaagtatcgcttattggaattcctcttatatagagtatgtaataactattttcatgtttatcggagctaccaatatgacattggtttatttctgttttaatggaaatgtgaagaaattgattaaagatgaggagtttcgctggtttttcttttttgttttaggcgctattatcgttgtcatggtgtggatcttgtaccttggattcgcctcggatgtagagaatgcgttccgtaaggcggctttccaagtggtgaccttggtttctacgtgtggattcgctacggatgactatattccttggggaccgtttttctggtttatcgcattgatcttgatgtttatttgtggatgcgccggatctacttgcggtggcttgaagatgggacgcttcgttattttaacgaagaatctctccaatgaatttaagaaacagacacatccccatgcggtgattccagtacgaatgaacgggcatgtcgtatctggtgatatcgtacatcgtgtgttagcttttgtgttcgcttatattacgttaatcgtggtgagctgtttggctttatctttggatgggatgggattttcggaggcgattggtgccgctgtttctgctataagtaacgtagggcccggcttgggaacgcttggtccggtaagtaattttgcggatgttcccacggtgtcgaaatggtttctgtcttttttgatgttaacagggcgtctggagatatttacggtattaacgatattagtccccggtttttggaaacagtaaaattattgaaaatgaaaagtatacaggtcattgctagtctgctgtgtggtattctgtattgtgggatttctttaaatgcccagaatgtattgaaagcaacaggttggatgccagagcacacatttacttccggaatagaaggtccggctgtagatagcgaaggaaatttatatgccgtaaattataagaaagaagggacgatcggtattgtacgcccagatggtagccatggctgttttctcgttttgccggaaggatctaccgggaatagtatccgcttcgggaaagacggaaatatgtacgtggcggattatacagggcataatatcttaaaagtggatatgaaatctaagaagatcagcgtattcgctcatgagccaaagatgaatcaaccaaacgatattgtatttgcctccaatggaaatatctatgcgagtgacccggattggccgaatcaaaaaggccaactttggttgattaccccggatgcgaaagtctccttattggagacgaatatgggaacgactaatggcatcgctgtgagtgaggatggtaaacgcttgtacattaatgaatctgctcaattaaaagtctgggtatatgatatatgcccggatggtactttaaggaataaacgtctatttcatacttttgaggggtacggtatggatggtatgaagtgtgacgagaaaggaaatctttatatttgccgttatgataagggtactatagctttgttaaatccgcaaggagatttagttgaagagattcaattgacaggaaagcagccgtctaacttaacatttggaggacctgatcatcgtcaatgttatgtgacattgcaggatcggggttgttttgaaacctttaaggttccttatccgggaaaagaatggtaacccgatatacgtttttgattaattttgcgttataataggtacggaatattaaaaagatatatagatgatagaatatataaagggtgaaatcgtggaacttacacctacacgtatgattttggagtgtggtggtataggctacgagctgaatatatccttgaatacatatagtgcgtttgggagtaagactaccggaaaaatatatatatatgaggtaatccgggaagatgctcatttactatttggctttgccgagaaaatcgaaagggagttgttccttttgcttacttccgtttccggcgtgggaccgaataccgcacgcatgatcctttcttctctaccgccatccgaattggttcaagtgatcggttcgaagaatgaggccgcattgactgccgtgaaagggattggtttgaagacggcccagcgtatcttggtagatttgaaaaataaggtgaaacctatggagagtatggccggaaacttgccggaggcatcagtctctaatggagcggtaaccgaggaggccgtagccgcattggttatgttgggtttccagaaagcggcttcgcaaaaagcggtatccgctattttgaaaggctcgcccactttagctgtggaacaagtaattaaaactgcgcttagaatgctttgataattgacaattgaggattaacgattaacaattgacaattaaatgagaaaatgagaaaacgaatactgaaatattccatatggatcgttgtattattgtttggtgtcggcttgtattcgctgaatgctgattaccttgcgtatacatcatctttgccggaattggagttgctggaagctccggaggatacgatccctccccgttatccggtaactaaaactacaccggaggaatatcaagatatcgtgaaacaatcacctgccgatttgcgtgatccggagaatgtcaagactacgattgagtatgatttaaagacgaatacgtatattgttcgtacgaaattaggcgatatggagattggtacgccgatgagtttaaccccagcggaataccaagattattctatgcaacaatcacttcgttcctatttccgccaaaagaacgaggaagaattccaaaaagctacgaataaacagtttaacttaaccgatatgcagtttaatatcggtgcggcggaacgtatcttcggccccggtggagtacgtgtaagaacacaaggttcggccgagatcacgatgggattgaagacgaataagaataatgatccttctcttccggagcgttcccgtaaacgtactttcttcaattttgacgagagtgtgcagttgaatgtacaagcctcggtgggtagcaaggtgaatttcggaatgaattacaataccgagacctcttttgatttcgattccaagaaattgaagttggcgtatacgggcgaggaggatgagattatcaaatcgttggaagccggtaacgtgagcatgaataccagcaactccttgattaatggaggtgcggctttattcggtatgaaagcggatttacaatttggtaagttgcgagtgaacgccttgtttgcccagcaggaatctgaatccaagacggttagctcaaaagggggcgtgcagacgaagcccttcgagatcaaggtggatgaatacgacgagaaccgtcacttcttcttgggccattatttctatgataactacgataagtttatggagtctttgcctaccgtcacctccggtatcgagatctctaagatagaagtgtgggtgaccaataaacgaggtaattatgaccagtcccgcaatatcgtagctttcactgatttgggagaaaatgaatctcgtaatatcggtaatacagccttggtaatgccttccggaacggataggcgtccgaataattccgcaaacaatttatatacgactttaaccactcaatttacgggtgcccgtaagattaatatggtgaatgatgctttgaaaggtgccatggagggaggacgggattttgagaaaatcgagagtgcccgtttgctagagtcgtctgagtatacattaaacaagaaattgggttatatttctttgaggactcagttacaggctgatgaggtattgggtgtcgcttttagttttatctataatggcaagacctatcaagtcggtgagttctctacggataataaagagaatacgagtgactgtatttatgtgaagttgctaaagggcatcacgatgtcgcctgatatgatgttctgggacttgatgatgaagaacgtatactcattgggtgcttattcggtgcagaaagaaaagtttaaattgaacgtaacctatcagagcgattctaccggtacgtatgtaaactatcttccagaaggtaattgtgcgaatcaaatcttgattcgggtattagggctggatcgcttggatacttatgacaatccgaatccggatggcttcttcgattttattgacggttatacgatacaggcggagaccggtaagattatattcccttgtgtacaacctttcggctcgaaattacgggaaaaggtaggtaatgcctatgccagtaaatatgtattccaagagttgtatgactcgacattaactgttgctcgccagatcgccgagaaaaataaattccttttaagtggtgagtataaagcctcgtcgggttcggagatcgacttgggagctactaacgtggcccgtgggtctgtacgtgtcacggcaggaggagctacactgacagagaatgtggattatacggtagattacagtttaggacgtgtgacgatcttgaatgagagcatcatatctagtggaacacccgttagcgtatctctggagaaccagtctacttttaatatgcagcgaaagacgatgatcgggttagacttgaattaccagttcaataaggacttcatggtcggtgccacggttatgcatatgtcggaaatgcctcttacggtaaaaaccactttgggagatgagtctataaagaatactttatggggcttgaatacctcttataaagcagagagccagtggttgacaaacgtatttgataagttacccttgttgacattgaccaaacctagccaaatctcattcaatgcggaattcgctcatttaatagcgggacattatgagaatcaatatacgggtggttactcttatttggatgacttcgagtctacacaaagtggtatggatcttttgaacccgtatgcttggaacttggcgagtaccccctatgaagattcgaatcctaaatttccggaagcggagaaggtgaacgatatcgcttatggtaaaaacagagctttgttggcttggtatacggtagacggaatcttcacacgtaagagttcctcttcccgccctcgacatcttacgaatgatgatttatcgaatcattatacgcgtggagtcagttataaagagatctttccgaataaagagttgggaaccaatgataatacgactttgccagtattaaacctcgctttttacccgaatgagcgtggtccgtataacctggatgcggaaaatgtaaactcggacggtacgttgggtaatccggaaaaacgttggggtggtgtaatgcgcaagatcgagcctagcgatttggaatctgccaattatgaatatatcgaattctggcttttagacccgtatcttgaggacgagacagccgaaggtggtgacctatactttaacttgggtgagatttccgaggatattttgaaagatgagcggaaattctttgagaatggcatgcctgtggacggtgatatgtcgaaagttgatacgactgtttggggtaaggttcctcgcacgcaaagtacgggatatgcgtttgatgcccaaaatcgtgagttgcaagatgtcggtttgaacggtctttctacggaggaagagcagactttccctacgtatgcggattatttgaataaattgagggcgaaactatccggtgagaccatctctaagatgatggatgatccattttctccttttaacgatcctgccggggataattatcactatttccgtggggatgattacgatgctaaggagttggatattttatctcgctataaacgatataacggtacagagggaaactcacaagaatccgatcaaagatatgctacagccggaaagagtacaccggatgtggaagatatcaatggcgataatacgttgaatgagacagagaaatattttgagtacaagatctctctccgtccaaaagatttgcaggtcggtgtaaataacatcgtcgatgagcgtactccggaagtaaccttgatgaatggtgataaggagaaagtaaaatggtatctatttaagattcctattaaagattatgagaagagggttggagcgatccgggatttcaagactgtccgtttcatgcgtatgtatatgacaggattccgtaagtctacggttctgcgttttggtaccttggaactggtccgtggtgattggcgtacttatacgcaggatttgtcaaatcctcttgttccgccaaagtctgatggacagatagtcgtatcttctgtgaatatagaggagaacgggcagcgtcagccggtcaactatgtgttgcctccgggtattagccgtatgttcgattccagccagcctcagttgcttcaacagaacgagcaggcattgtctatgaagataacggatttatctcctgcggatgcacgtgcggtttataaatctaccgcttatgaccttcgccggtataaacgattacaaatgttcgctcatgcggaagcgccgattgatgagagcaagactttgtcgaatggtgatttctctgtatttattcgtttaggttctgactataagaataattattatgagtatgaggtacctttggatctgactccccatagtactattctttataatacgaacaatagcgcggatcaagaaaaagtatggcctttaaataataccttgaattttaaattggagacgctgaccgacttgaagttggagcgaaataaattgaaacgtcagggacagggaaatataagctaccaaaaggtttattcgaaaaatgatccggataatacgcgtaataaaatcagtatcatcggtaaccctagcttagcggaggtgaaagtgatcatgatcggcgtacgtaataatacgggtgatatcaagagcggtgaggtctgggtaaacgaacttcgtatgactgatttcgatgagaaaggtggttgggccgctaatgcgaatctgaacgtcgctttatccgatttgggtacggtcaatgtaagtggacgaatggaaaccgccggttttggtgcgttggatcagtcgctggccgaacgtcggatggatgattattcgcaatatagtgtggcgacctcgattgagttgggtaagttgttccctgagaaagcaaaggttagcatacctttttactatgcttattcgaaagagactacaactcctgagtatgatccgttgaatgaggatattaagctttcggacgctttggatgcggtagagacccaagccgagaaagactctatcaagagttattctttggaccagaccacgattaagagcgtctctttcaataacgtaaaggtggatatccgtagtaagaatccgatgccgtatgatccggctaacttctcgttaggttactcttatagccagaacagtaagaagaatccggagaccgaatatgagacaaccaaggattaccgaggtaatttcgcttataattatacgccttacgtgaaaccgttccgacccttcgagaagctgaagaagaataatggatatacaaaatatatcaagcaattcggactgaattacgtcccgtcgaatattagtttccagacggcgatgatgcggaattactatgagattaagctaagggatttgacaagttctacggatggaggtaaccagttgctctcattcagtcacaatttcttgtgggaccgtgccttcagtttgcgttgggactttacgaataatctgagcatgacgtttacttccggtacgaatgcccgcatcgaggaaccgaatgttcaagtgaataagaaattgaatccggatgattatcaggtatggaaggattccgtgaagcaaagtatccgtgatttgggtactcctttgaaatatgaccaaacgtttaatgtcacttggaatatgccattgcaattcataccggcattggactgggtaaatagttcattgacttataatgccacgtacaactgggatcgtggagccaatgtcgctagtattgagttggaacagggtaatataataaagaaccaacgtcaatttgactggcagggtagtttcaatttgcagtcattgtacaataagaataaatatctgaagaagatcaaccagaaatttatggcctcttcccgggtaagcgctcgtcaaccggagaaaaagaagaaagaggtgaaactagagaaagagatccaattgagcccggatagtggaacgatcgtgcagcatggaatgtttacgaagaaggttcgtatcacggcacgtggagcggacgggaaggtctattcaattaaatacaagccgatcaattacgcccaagtcatgatcttgaataaggatacggcccgtttgaagctgacaatcgtgcccggtcctcagcctttggaaggaaccttgacgaaagtcgctgaatatagtagccgtttcttgatgatggtacgtcgggtaaacatacaatattcgttgatagacggtatgatgttgagtggttacgcaccggaggttggtgatatgttcggacaacggcgtacaggaactttggctccgggactcggttttgcttttggagcggtaagaaggagctttatcgacgaggcggacgagcggggctggctggtaaagaatgagaatatgacgactcccgccatgatcaatagcgcgaagaatcttacgattcgtgcgaatctagaacctatagccggcttgaagattgatttgaacgcaaaccgggtagatacccgtagtaccgatatctattatatgcaagacggtatgcccgagcagatgggaggtagcttcacgatgactacgattgccttggggagcgctttcggcggcagcggaaacgctaataacggttattcctcgaaagcgttcgataaatttatcgctcatcgtagcgtgatcgcccagcgtttgatggatacctattctggtacggtttatccgagctccggttttatggcggggcatgctttagcgggaaaaccttatgatccagccgtagggggaggcgtaagcctgaattccatggaggtattggtacctgctttcttggcggcttatacgggtaaggacccgaataaggtaggcttgtcagccttcccgtctgttaagagcctgctaccgaactggcgtgttacgtatgatggcttgatccgtataccggttatccgcaaatactttaagagtatgatgttaagtcatcaatatcgttgttcctatagcgtaggtgcgttttcctccttcttggattgggtagatgccgggcaggatggtttgggatatatccgcgatatccagacaggtaatcctacgccgtcgtctccttatgatatagcggccgtgagtatcacggaaggattcagcccgttgtttggtgtggacgctactttattgaataatataacaggtaaatttgagttgcgcaagactcgtaacttaagcttgaatatttcctcttaccaattggtggaagcgctttccaacgaattcgtgataggagtaggatataagttgactgagtttaacaaggtgttgaaaatgaaaaagacacgcgacttcagtaatgatcttacgatccgcttagatttctcttaccgtaaaatgcaatcgttgatccgtaagattgaggatcagtttacgcaggctaccagcgggaatatcgccaagaccatccagttctctgcggattacgggttaagtcgtgccttgacattgagagcgttctatgatttacagatcaatgagccgatcgtgtccacatcttcttacccgacatcgaactcgaactatggtattagtttacggttctccttagcgcaataaaaagagtatagtctatttacaggacttcttggtctgtttttaaatacctgtctagcggtatggaataaacctttatatttgtgcgaaatataatttggatatgaagaatacttacaaattgatattatttcttctcttgataacccatgcctctttcggccaagacgtgaaagggtatattaaggatgcggagagcaaggaagctttagccggggtaaacgttttttataaggacaaagggggtacgagaggaactgtgtctgatataaacggttattatgagctgaaagtgacggatggcgacgctgtattgacttttagctatctgggatatgaaacgttgagcgttcccgtgaaagtagatccgggagagttcttgacgcatgacgtatccttgcgaacaaactcaaacatgatggacgaggtcgtcgtgagcgtcgggcgttatgagcaaaagctaagcgatattaccgtctctatggaattactgaaagcgaaagatatcactcgtcagtctccgaaagatttaacggacgtattgaagaatatctccggtgtggacgtgacggaccggcaaccttccgtacgcggtggtacgggatggacctatggcgtgggtagccgttgcttgattctggtggacggaatgtcggtgctaactccgggttccggcgagataaactggaatatgatcccgatggagaacgtcgatcaagtagaggtactgaaaggggcctcttccgtattatatggctcttctgccttgaatggtttgattcacgtgaaaacgaaacgccccggattggatccggtaacacaggtgaacgtacaaggaggattgtatggaaagccgcgccaagacgggacgcctttatatggaggcttggatctctctcattcccgtaggatcaagaattttgatttgacagtgggggctaatacattcttggacgacgggtatcggcaggataattacaatcgccgtgtccgggtcggtgggaatcttacgtatcacgatccccgggtacaagggttgaactatggcgtgaacgtgaattatttgtataacgattataccggtttctttatctggcgttctccggaggagccctatattcaatctccgctggcgaatatgggacgccgtgagaatacattttatatagatcccttcttgaattatacgaattcggaaaaagggacgactcatcgtttcaaggggcgtttcttccatcggggaagccgtatcatcacgcatactacggataagtctctttttgacataacgaataatatgggttttgatatctcatccgtcccggagattatcaatatggcgcaaaactggcaaaccgagttattgccgaccttcttaccgtatttgccggaggtgatgaacgggaaggtgagcggattgatggctgaattgggcaagctgggaaatcattttttcccgacagctacctcggcggattatatggacttgatttcttgggtgatgggacgtactccgctacccgataagaataacgtaggggcttggttggtagatgccatgaaaccgatggagaaaaaagcgccggaggctacggatcatacctattcctataatctggattaccaattcagcaagaagttcgaacattcacaactcacggttggaggtacttatgagcgtattcatgcggattcgaaagtgaccgggcagcatagtagcgataatgtggctaccttcctgcaatatgatcataagtttatcgatcgtttgaacgtctcggtcggtgttcgtctggagtattaccgggtcgatgatttctaccgggaagcggagacgaagattttcggggcgaaggttccggtaaaacctgttttccgtggaggcttgaattatgaattgggtgagtatagttttatccgggcatctttcggacagggataccgttatccatccgttacggagaagtttatcctgaaggatatcggaggtgtgggagctttcccgaacgctgaattgaaagcggagcaaggttataatgccgaacttggtttcaagcaaggctataagttcggcaatttgaagggctttatcgatgtggccggcttttatacccgttacaaggatatgatcgagttccgtttcggcctgtttaataataagaccttcgattatatcgatgggctttccaagttgttcaatgcgttctctagcggcgacggcttaggaatcggcgctcagttcacgaacgtaggccgggcggagatttatggggtagacttgtctacctcgggtgtgtatgagtttaaccgtgatactcgtctggcatatactttggggtatgtttatacgaatccgatcgatatggacgtggattcacggaacgcggaggaggaagcgaatgatgacttaatggcgatgcgttcgaaatcgaatgacagcaagtatttaaaatatcgccagaaacattccgtaaagggggtatttgatctggaatggaaacagtttaatatcggaacgaatatgtcatggaaaagcaagacattggcggtcgattattttatggtcgatgagcgtacgaaagcggagcctaacctgatggattatatgcgctcgatgctattcggaaacttacatgattattgggcagagaacaataaaggatatttcgtcatggatatgcgtgtcgggatgaaagtgacgaagaatgtccatgtacaaggactggtgaacaacctcttaaacaagcgctatagcgcccgcccgatggatgtcggcgcaccccggactttcattctgcaagtaggagccaatttctaacaaattacctagttgtagagacggagcgtgctctgtctctacaacatgtgatagtttttcaattcgcttcgtaaacgaatcgcttgattgtccgtcaccttatccatcagtttccagaatctttcgctatggttcatctcgatcgtatggcaaagctcatgcaataatacataatccaccaaatgccaaggaagaagcattaatgattgcgagaggttaatgctcttcttcattgtacaacttccccaatgcgttttgctattattgattttcaccccggtcaacataaatccatgttgtctagccaatagcgtgatacgttccggcaacaaccgtttcgcctcgtggcggagcgccttctccagcatggatttcaataaggattgcacctcttcctcctcgaaacgagtctcattcggacaagcgatatgcagtactccatcctccaatctcatgtagaaattacttcgctcggtgcggaagatatgcaagcggaatgtcgtagcctgtaactccgatctttcgtcgagcaggggccgggccggatgcttctggagcgcttttaccagccgggccttgttctccatgataaaagcgatcatacgtttctcgtctcccccgggtggcatcgtggcggttatctttccttttgatatcttgagcgtgtatcgagtggcccggggagtggtacggagcgttatgactcccaaatccttgtcttgtatattcttttccattcctgccacaaaagtaatacattgagaaaaacaataatacgatggaattgattatcttcgcgatcgtaaaggttaaaaacataatcaatataataaattagcaatcatgagcaaaaaagcacttttaattatctgtgatggttggggaattggtgacaaaggtaaagacgacgtgatctttaacacgccgactccatattgggacgagttattgaaaacttatccagcctcacagttacaggcttctggcgagaacgttggtttgcctgacggacaaatgggtaactctgaggtgggccacttgaacatcggtgctggccgtatcgtttaccaagatttggtgaagatcaacatcgcttgccgcgagaatacgatcatggagaacccggagatcaaacgtgcttatagctacgcgaaagagaataataagcagatccacttcatgggcttggtttccgatggtggtgtacatagctctttggagcatcttttgaagttgacggatatcgccaaggaatacggaatcagcaaggcttatgtacattgcttcatggatggccgtgatacggacccgaagagtggtaaaggttttatcgagacgttggagaatcatctgaagactaccggcggtaagatcgcttctatcatcggacgttattacgctatggaccgcgacaaacgttgggaacgtgtgaaagaggcttacgacttattggtcgaaggtaagggtaagcaagccgagtgcatggtaaaagcgatggaagagtcgtacgccgagggtgtaacggacgagttcatcaagccgatcgttcacgttgagaacggaaagccggttgctgttatcgaggaaggcgatgtcgtgatcttcttcaactatcgtaacgaccgtgcgaaagagcttacggttgtattgactcagcaagatatgccggaggccggtatgcatacgatccctggcttgcaatatttctgtatgactccgtatgacgctagcttcaagggtgttcatatcttgttcgacaaagagaacgtaaataatacgctgggtgagttcttggcaaacgtaggtaagactcagttgcatatcgccgagacagagaaatacgctcacgtgactttcttcttcaacggtggccgtgagactccgttcgatagcgaggagcgtatcttggtcccttctcctaaagtggctacttacgacttgaaaccggaaatgagcgctttcgaggtgaaagataaattggtggacgctatcaatacgaagaaattcgatttcatcgtagtgaactatgccaacggtgatatggtaggccatacgggtatctacaaagcgatcgagaaagcggtcgtaacgatcgacgcttgcttgcacgatacggttgaggccgctaaagccaacgactatgaggtaatcatcatcgctgaccatggtaacgcggatcacgccttgaacgaggatggcactccgaatacggctcactccttgaaccctgttccattcgtttatgtgacagccaacaaggacgctaaagtagaggatggtatcttggccgatgtggctccttcaatccttcacatcttgggcttgaaacagccgaaggagatgactggcaagtcattgattaaataagagctaggcgcatcttatgatccagatagatgacactttagtaagtcttgacgttatcgagcgttattttttatgtgatctttccaaatgtaagggggagtgctgcgtggaaggagattccggcgctccattagaggattcggagttggcgaagctccagaaagtattgcccattatctgggatgatttatccccgaaagctcaagaggtcattaataagcaaggcgtagcttatatcgatgaggaaggcgatacggttacctctatcgtgaacggcaaagattgtgtctttacctgttacgacgccgatggtacttgtaaatgcgctattgagaaagcataccgggaaggtaagacggatttctataagcctgtttcttgccatctttacccgatacgtgtcactcagtatcgggatttcaaggccgtgaactatcatcgctggagcgtttgtaaggcagcggagatcttaggaaagaaagagcaattgccggtttataagttcctcaaggagcccttgatccgtaagttcggccaggcttggtataaggccttggaagagtgtgcggaggaatggaagaagcagcgtgaggagtagcttttagatcgtttataaatattaaaaatcccttcagtctctccctttgataactatacgttaaaaacggatggaggctgaagggattttgttttatagtcgctctatttcctcaagggaaaggccggtgcatttttggatgataagaggggttattccctcggctttcatattacgtgccgtagattctttccctttttgcagtccttcttgcaatccttcttgtaatcctttttgcaatcctttttccatgccttcttccatcccttttttcatgcctttctcaacggcgaagtccaaggtgttataataatcattatacatcttccactccgcctcgtactgcgctcgttgtttgggggtgaggttcgccatggatccgatgcgttccaaccgctcgaatatggccttgcgtgccttgaaaggcattctgtctaatgtatccatatgctttagtacataaatccaacgttcaaaatctgtctcgcattcttcctcctctttgttgaatcgaggaagctcaatatagatctggcggaacttggggttgaatacctgtccgttctcccgatccgccagcacgatgtcccttcggaactttccttcgttcctgttattgtttggcctgttctcctcgtctagcgtgaagttcaagaaaaaaacaccgtacacggccgccagctcatagtcccatgttccctttatcccctgttccaccaccgagtgcgagaggtagtataaggccctgtccttgaagtggggctgttccctgttctgcatctcgattatgatccgttcgcccttgtcggtctcgcaatggatatcgaagatgaccttccttccttgctctgtctcgggcaatcgctcattgttcatgatcctcaggtccatgatagtatactccccttcgaggaggtcattcaggaactcgattaaaatgtccttgtccatttccctgccgaatatgtgcttgaagccgaaatcggtgaaggggttgataaattttcccatagtgtttataggttttagtgattaataggatatagatggctcttttccatctttggcgataaagatacgatttttattatatggggcattcatttaggctttaaaaaaacacgtacgtctttttttcggaaatatcttgtgtagtttgagtgaagacgagatatagtgaacgcataaaggatacagccttaaagctaaaggtgggttaatgaggctttccgcgtcaaatgtaagccatagcttatttgaaaatacgggaaacatgtgcctgtacaggccctgataaccaagaaacgggccctctcattggctgttgaagtgaataactaatcacttggaaagcctttttatatcggaaccaacaaggtcttctcagtggctttgggatgcggttcagttatcctgcggggcttttccatgtcgattattctgttatagccctcgcagatggatggtaagcgaagcggcgataatcatgacagtttgcgcgaaacaaggctgtttgtttgacatacctcttctttggtgaagtctaactagagagaagaaataggtgaaaagggcctttttgtctcttatttataggtaaaaggtcgcttttccggtgagaaaggtggtgtttgcctacgcaaatatatgcgttagccaacgcaactgtatgttttagccgacgtaaccgtatgtattaggtgatacatacggtagtaattcccatcgcatacgatagaaatggccttcacatacggatgaattacaggttttagccttaagaatatgaattaggatgaataattttcgccagaacgaaagggcatattccgttatcttgttatggaataactacttgcgaatattttttctcgttttacggaactatatgtataatctcccggaaaattcgattctcaagggctttaatttacaaagtgtcacaatgacaatccgtaaattccggatgactcgtttaatataatattaatgtacgcctgtacattaattaatgctatactataaaagttgatgaataatagattgaaatgatatctggagtatggaaacgactagtttaaacgaacgattcttttagtcatttgcaaaggtacgcgtttcttcgatacttgcaacccttccgggctatttttttacagcttattctctttcttatcaataggataggttatcctttacgaaacaagcgattccttcaacaaacctttctatttaccccttataaaacgcaagattaaaaccttcgtttaaactagtcgtttttgaatgacaaagcaatcgatacgataacgtaatgagctgattatcttaataaacactagtattaatattaattttagaattatgaacaaaaagttttctactcttttggctggtgctgcgcttctgggtgcggtgacggctaatggtgctgttaagctgaatcaaggagcgaataacggtctttatcagcttaaggcaggttctgctttcttgagtattaccgaaaattccacgactcacgaagatgaaatcaaaatggtttctcactcttccgcaaatttaggaggtacaatgtggtgtgtaacggttgatgccgagaatcaaggacagaatcctaagtatgatttcacgaacaagatcggaaagtttttaggtcttgagatcagcacgatcaaaggtaaggcggcggctccgttagctgctgtacctgctgttgtcggtggtgatctttccggttggaaattctctcctgtatttaagaatggtgtggagaaatccgttctctattcttatttcacgaatgactctgtaatcggtttgaaggtgaatactagtggcgatgtagaaatggttaaaactatagctactacagctggtattactgccgctggtttcactgaatttgagttggtagaggccgcttcgatcgttgtctcaggtgctgatgaattgaatacgatctttggtacccaagataagaaagctggtatcacattgaagtttactccggatgtattaggagatggagcggtaaactactttaccgagaagaagttcacggttgaagcttctggaactgctaattatttccatgtattgagagccgactcttcttacttgtacgtagatactgcttatacgaatgctgtgggtggagctaagttcttggcttataactggagcaacttaaaggatacttataagactggtactaagaatcatgctactccgaaagattctatcaatgctacagatttatcagaccaatataaatttatgtttacatattggccttcaaatgacagcttggagattcaggttaaacaatctttgttaaaaacaagtgagacgtattggaaagatgttactgctactacagctatgcaaaatcagcatatctctttgcaagagttgctgaaagacaaggttcgtatcttgacggtagatgcggctcaaaatactaagattgagttaggtttcgcaggttgcaaagttttgcctactacaaagacaactgttgatgatggtgtttatgtaatcagaaatgctaagactggtaagtactatgctgctccgctttataatgaatctgcatctagtaaatacgagtgggtgactttggatattcaagatgctgctcatatgcctgcttatcaatgggttgtgttgaagaagaacgtaacagataagaataaggtttctgctgtagatttgtataaccgtgagtataatgacggtacggctgctgatgcgactctccaattgaataaaaatgcgggggctacttatatgtatgctgctagttttggtgactctttggaatttatcccagtcgctaaagaaatctatactgataagtatgtgggttataagcatctgactaatgatgagttgatcacgaacaaatatactttcaactactggcatccgtacgcatctgataaatttatcggtgttaaggattctacgatgaatgtgttagagggtaagaaagcgttcactcttaagtcttcttacaaagaacatgcttatggctataatccttctgaggaggtttccggtaatgcggacaagaagatcacgggtcgtatccctggcttggtgagaccggtaagaacgatgtatatcattactaatggtgagactactttccgtaatcataacgtagcggtagagtctaagtataaattgagtaagtattatcctaatactacgaatgactctgtttacttcaaggagaacaaccatattgagggtaaccattactatgctatccttgaggctacttccacaggtgctatcagcactcataaagcaggtgtttccgattatgatgcttccgctactttgaaagctcaggtaatgggtgagactcgtacttccgcattcgctatcgctccggacgagactccgttgtatcgtcaattcaataatgaacttcttggtgagaacgttgataattcagctgatagcttgatgttcaaggaaactatccgtggtgaatatttgatggatgagcataatggtgccttgttgaacaaggatgttgattacgctggtatctggagtgagggtaaggctgatggtaagttggctttccgtattgacacagcatggttaactcgtggcgcaggtaaggttaaacctcaatacttggtatccgcttatcgtgagttgatcgagggtgagaagatcattccttgtactgagacaggcaagcatatcactgctgatggtcaagttacagaagatccatatcaatgtgtacatgctgttcatgtgaagactccagcattcatctatggtaagtatttggttaactactcagactctgctgccgctgttgctgctcgcaaggaagctcttaacccgtacttgttcaatacgaaagcagtttcaaacagtagctatactcgtgtaggtttcgttcctgccgttcaatatggtgataccttgatcgttttgacaggtaagtacaaagctatgactgctgatcaattgaagaatgagggaatcgagtctattatggctgtttataagaaagattatccgaaattcatcaacgtattgtctggagacaagcataagaacgtaacttggtcattccgttatgtaaatccggataaggctgctttagcttatgtagatggtaaagagggtgagaacaactcattcttgatcgagtctaacgtatatgcaacaggaacagatggtgataatcaatatcagactatcaagggtgatttggcaaaagctatcgctcctaatgaagctgccgcatggttgaagatgcacaatggctgcttggtattgacagatgctagctctacatttggtgccgctaagactggtggtgatggagcattggtattcaacgcatattctaagactgaagatgatgatatggtaacatctaacgataacatcaacaatgttgaaggagtatctgtaatcgctggtaacggtacagtaactgttcaaggtgctgctggcaagtctgtagttatcactaacatcttaggtaaggttgtcgctgagacagttcttacttctgacaacgctacaatcgctgtaccggctggtatcgtagccgtagctgttgatggtgaagaggctgttaaggtagtcgtaaaataagactaaccgatggactaaacgaatagaggcggggagacccgcctttatgtaatatataattaaataactatgccgcaataaagaagtatcccgtgacgggtgaacacgtggcatattaatactaaagtaattaaaagttcttccgcaggtatcctcgtgagaagagagagcggatcaaaaaacaagccccgtgggatttatcctatggggcttttatttatcgtatcgccaccttgcgtaccgtatcgccaatgcggatgatataatatccctttgcgatatctacgacatattcggcggtggactgcttgacttcgatttctttcaccttgatgcctacgacactgtagatttccaagatactcccgacaggagcgttctctaccttgatgcgattctcgtaggccgtgatttcgataggagagggatcttcttgcctagaagcaaatgtcttgactcccgatttattagcttgcgcataaaccggataacttgcggagaatgcaagtgccaaagcgatgatatgtataagcttcatttacttgtccctaaattcgtacaaatgtagaaagttttccgcatattagaaagtaattagctttatttcgtaaaacggatgtatgattatacgctaagcctcataccttcctctcctaagatcgtgccgggaaatatcttgtctgcttctttctttaacggtgccatatcctcgtaacgagccgagtaatgaccgataaccaatcgcttcacttgggctttataagcaatctcggccgcttggcgggcggtagagtggaaggtctctttcgcacgtgcggcgtcacattcagcgaaagtcgcctcgtggtataataaatccaccccttcaatgatggggattatagatgggtgaaaagctgtatccgagcaataagcataccgtttgggagcgacggcagggcgggttaagcgggcattcgggattacctctccttccggggtgacgaaatcagcgccccttttgatctcttgcatcatacggacgggaacttgatagaaatctgtcatctcccggatgatatgcgcttctttggctttctcggcgaataaatagccacaacagggtatacggtgctttaacggaatggaataaacgcttaaggagcgatcttccataaccaacgaatgagttgtcgggtcgattaagttaaaacggatctcataaggcaaccctttacaaaagatatcaagtatcggacgcatatagctctcgatctctttcggcccatgaataacaagttctccattacgtcccaacatacctaatgtagagatcaatcccggtagcccgaagcaatgatctccgtgtaggtgggagatgaagatatgatttaaacgactgaattttatacgcatacgacgcatttgcacttgcgtgccttctccgcagtcgatcatgtatagtttatctcgtaaatctactatttgagaggtcgccagatggcgtgtcgtgggcaatgcggaaccgcatcccaatatgtttatatcaaaatcagccatttgttgtctatgggaataattgagtgcaaagataatacaaaagcatttctgttctgtgaaaaataacaaaaaaacaaagtgtaatgtatgcaggatgaggtggattccatatatttgtttgctgtccttcgggaaagcgaatatacagtcggtaaatagacttaagatatttttttctaagccttaactaactttttctttttgtttaaaacggttaaatgtagaaacggccaagcgtgagcttcgccgtttcctttttttattgttattttgaaatctaaatacctatatctaataaattatgtcatttaacaatctacgattatgaacaagaattttatctctgttttcttcctgatgctcgctatgggcgtatctgttatggcccagagttatgaggaagatttggctttttttaaggaacgagtaaagactttaggctcggatgagttcggagggcgtaagcctttgaccgagtatgagacgaaaacaatccattacatcgctgatgaatttaagaaactaggtcttcaacctgctaatggcgatagttatttccagccggtgaaggaaatatctacttttacccgtccggtaaaggataagatcacggtgaaatgcgcgaaagggtctatggatttgaagttctcggatgatattgtcgtttggacgaaccggggaactgagcaggtagttatccctactacggactatgtgttctgtgggtttggcattaatgcgccggaatatggatggaacgattatgcgaatgtagacgtgaaggggaaaatcgttatcgctatggtgaatgatcccggtttttatgatacgtctttgttccgtggaaagaacatgacttattatggccgttggacttataagttcgaggaggcgcaacgccaaggtgccgcaggtttattggttcttcataacgaggcggccgcttcgtatggttggaaggtctgtcaggcttctcacgtgcagacaaatatcgctctttgctcggagacaatgaatgcggaagctttgggcatgaagggatggctctcggaggaggcttgcaagaaaatgttcgcccttagcggattgaattttgatgagacgattgccgcggcgaagaaaccgggtttcaagagttttacgatgaaggcgaaaagtaaggttatattaaatgtaaagatgactgtaggcgagtctcataacgtggcggctgttttaccgggcacggacctgaaagacgaatacttggtttttaccgctcactgggatcattttgggatcggcacgccgatagatggggacagtatctataatggcgctagcgataatgcttcgggcgtggcaaccttaatgttattagctaagaaatatcaatcattgcctgttcattcccgtcgttccatcgtattcgtggcggtgacttccgaggaatgtggcttattaggttctcagtactattgtgagcatcctttgttccctttatctaaaacggctattaacttgaactttgacggcacggctccgcgtgagcgtacccatgatatttctctccgggctgcgggtaagacggatacggatgccttggtgatcgctatggcctcggcacaaggacggaccgtgaaggttattaccgaagatcctgcgggtggttatttccgttccgatcattttaatttcgtgaaaaaaggcgtacctacgattttagttggtggcggtaaggattacgtggataaagcacgccatgaggctaaaccgaaagtttaccggtatcaccaaccgaatgatgagtatgatgaatcttggtgggattttgatggggctatggaagatatgaacttaatgtttagtatcggtttagttatcgccaacaatgatgagatgcctaagtggacaaaagaggcggacttccaaaggcaatagattaatgtgccaatgtagcaatatgccaatatgctaatgtgtcaattaagatactatcacttgtattctcacttgacattgacatattggcacattggcatattatttaatttgcacattatttaataggtatgacctccttcttgcatttccttactattgatcttatgtagatcaagcgctctccaagcatagaaaatgtaggctaatacgaatggaacgagaatagatacatagctcattactttcaacgtgaatgggcttgagcaactattctggatcgtcaatgaactttgtagatccgccaaagatgggtagtaagccgtattattccatcctgcgcaaagtaataaagctaatacggtcaagacagtccctgctcccgcaaaccagatgccttttctccaagtcttcgagaatatcgttttccctatgccgaatagcacgccaaccacgccaatcaataatacggctaacacgattggcatctcgatcaggttcataaaatacttatacggttgcataaatacttctccggtatccggatttacggcaaaaccgtccaccaacaataaacggatcaagaatgtcaagaaaaagacgaggaacaagattgtctccggtatcaattgtttccggcttttagcgacaatctccggatcatcgatattgttgataaaatagagtagggccagagctcgtgccaagaagaaaactgccagtcctaggcacaaattccaaaataccaaagccgcctctaatccatgccaaggattggcccacgtggaaatgacgggcatggctacatcagtcaactgttctttgttaacaataaattcagcgccgttaaagaaggtcgctacagcggttccgagtaagatcggacctgctataccattgatcataagaaatacttgatacgtctttttcccgagtaggttgccttttttcgcttgatactcgtaagatacagcttgtatcacgaagcaaagcaagatcagcatccatacccaataggctccgccgaagcttgtggaataaaataaagggaaagaggcgaagaaagcacctccgaaagtgaccaacgtagtgaaagtaaactcccacttacgcccggtcgagttcaataacattttttgctgtatctccgtcttgccgatagtgaagagtagagattggcctccttgtacaaaaagaaggaatactaatagcgctccgagtagagataccagaaaccaccagtaatgttgtaacaatatatatgtactatccataggactttctatttaagaattgatatttgaaaattgaaaattagtgggcggcagcttccggccctttcttgatggccttaaccatgattccaatctctgcgatcagcaggatcgtaaataagataaggaacaggtagaaagtggtctgtaccgaggatgggtttaacttggatatcgaagcgctggtcggcaagatatcctgtatagcccaaggttgacgtcctacctccgctacgatccaaccggcttgtcccgctatatatcctaaaggtatagaccataggcccacgtattgcaaccaacgtgtattagcgattttcccttttttatcccatatcaacgtaataatgaatagtaagatgaagaaacaaccaaggatcaccatcacacggaaagaatagaatgtcaatcctacatgcgggattaactctgccggatccttaatataaccatatccgaaataggggaaattctcttccaaggttaccctgtattgtgcggctgctgcggtatctttatctttaaccgctttgcgataatcagctaacgctttgatggcggttttacctttctctattttttctttggcggagagcgctaccgttcctttattggtcgtataacctccctctattaagtttacgattcccggaacgtatgcgttcatgtcacgttctgctaagaaggagaggagtttggggaacttaatgtcaaaaataaatgcgttctggttatccagataactcgtctttgccggatttaagatgccgatacctacgagtcctactccgttgccaccctcataaagaccttccatggcggctagtttcatcggctgcttttgagcgacttggtaagcggagccatcacccgtccagataataaggatggaggctaccaacccgaatatagcgctgaccttgatacttgacaaagcgaattcggtattccgtttctttaataaataccagcagctgattcctagtacgaacaaggcgcctacgatccaaccggacaataccgtatggaaaaacttattaatggcgacaggcgataaggctacggcccagaaatcgaacatctcgttacggaccgtatccggattgaaatgcataccgaccggatattgcatccatgcgttagcgatcaagatccagagagcggaaagagtagcgccgataatcgtcagccaagtggaggcgagatgaaagcgtttgctaaccttgtcccaaccaaaaaacataacagcgataaaggtagcttccataaagaaggcgagaattccctcgatagccaaaggtgccccgaagatatccccgacaaaccaactatagttagaccagttggttccgaactcgaactcgaggatcaatcccgtagcgacaccgatagcgaaattgataccgaataatttcatccaaaattgggcggtctttttccatgcctcattacctgtccgataataaatcgtctccataatagcttggataacgccaagtcctagtgttagtggcacgaagagccaatgatacatggcagtaagggcaaattgagccctcgaccaatcgatcaatgaagtgtcaatgttttcaatcatatttattaatgttttaaggatttattgcccgttgtatgagttcgttcgatacgtggttctccttctcactatcgctatcgaattgcccgagataattaggaaagaagaataatctcaggataaaaaacatgataaacaatttgactagaatgattagccaaagagtcttgcccagcttcatctcccggaatccttccagataaaagcgatatattcgtatgaatgcagattcttttttcatatagttgttctcatttaagataacagttgttaatatgaatatgttttcatgtttttacaaatatatccaaactgcgttaataaaatacccccaatcctatagataatatttatgaaattataaataagatctatcctgtctgttaaaaaaaactattttaaataagaaagcggtcttttgatcttgtcaataatacagcattggctatatttgcgacaatttgttgcctgtaaaggtgtaaagacacatgaaatatcattgttaagtgctaatctataaaaaattattactatgtctaacatttctagaagatcttttcttcaaaaaggtacggctgccgcagcagctttgactattgttccgagtgcggtcctaggtaaaacccatggtcatatcgctccaactgataaattgaatattgccggtgttggtatcggaggtatgggtaacgctaacttaaagaacatggagactaccgagaatatcgtagctctttgtgacatcgactggaagtactcaaaacctgtattcgaccgtcatcctcaagctaaaaaatactgggactatcgtaagatgtatgatgagatgggtaaatctattgacgctgtgttggtagctaccgctgaccatactcatgcgatgatcacagctgacgctatgacgcttggcaaacacgtatacactcagaaaccgttgactcactctgtttatgagtcccgtttgcttacgaacttggctaagaagtatgacgtagctactcagatgggtaaccaaggttcttcattggctgaaggtgtagatttgatctgtgaatggatttggaatggtgagatcggtgaggttactaaagtagaatgcgctaccaaccgtcctatctggccgcaaggtttgaacgctcctgagaaagttgataagattccttctacattgaattgggatttgtttacgggtcctgctaaattgagaccgtttaataagacatatcatccttggaactggcgcggatggtgggattatggtacaggtgcgttgggtgatatggcttgccacatcttacatccggtattcaaaggcttgaatttaggctatccgacaagagttcaaggttcttctacattgttattacaagactgtgctcctaacgctcagcatgttaagttggtattcccggctcgtgataatatgccaaaggtagctatgccggaggttgaagttcactggtatgatggtggtatgatgccggatcgtccagaaggattccctcaaggtaaggaattgatgggtgaaggtggtggattgtgtatcttccatggtacgaaagatacattgatctgcggttgctacggtgttaacccatggttgttatctggtcgtaaaccgaacgttcctcaaacattgcgccgcgtgaaagacgctatgaagggtggtcacgaacaagactggattcgtgcttgtaaggaaagcgcaggcagccgtgttcagacgaagtctaacttcttggaggctggtccgttcaatgaaatggttgtaatgggtgtattggctgttcgtttgcaaagattgaataaagaattgttgtgggatggccctaacatgagatttacgaatatcgatccgaatgagacaatcaagatcatcaagaaagatacattcgaggttatcgatggtgacccgaaattcaagacagagtggacggatccaattaatgctcaagaatttgccgcaggcttgatcaagcacaactaccgtgaaggctggaagttggtagatatgccgagataatagttttaactcaataaataaaatgaaaaagtcagtattattagcaagtgccgctatcatgatgtgttatttcacttcttgtggtggtggaaagaaaacagaagaagctcctgcagctgctgagactacaacagaagccgcagctcctgagtacaagctcatgacagatcttcctactgtagatatcacgactttcccgaaagataaagagggtagatatgtgatcttcgatggtaagacattcaatggctggagaggttatgaccgtgctgacgttccgggtgcttggacaatcgaggacggagcgatcaaaatcaatggctctggtgctggtgaggctggtgcttccaacggtggggacttgatcttcgctcataagttgggtaacttcgagcttgagttcgaatggaaagtaggtaaaggctctaactctggtgtattcatcatgattcaagaggtagagggacaaccttcttacatctctgctcctgagtaccaagtattggataacgagaaccaccccgacgctaagttaggtaaggatggcaaccgtaaatcttcttctttgtatgacatgattcctgctaaaccgcagaacgcaaaaccgttcggtgagtggaacaagggtaagatcatgtgctataagggtacagttgttcactatttgaatagcgatgaacctgttgttgagtatcacttgtggactccgcaatggaaagaaatgttggataatagcaaatttagcaaagacaaatggccgttggcttatgagttgttgttgaattgcggtggcgctaacaaagaaggtttcatcggatttcaagaccacggggatgatgtttggttccgtaacattactgttaaagttttggattaatcgtatcaagcacattttagcataaataacgcccgaggcctaaatctatgattttagcttcgggtgttgtgtttttaataatcgactttttctaaaccaattttttaggaccaagaaatgaaaatagaacaaggttacacgaaagcgcagatgacttggctgatgatgctgcgtctttttataggttggcactttatgtatgaaggcctagtaaaaatcatgaacccaaaatggacatctctaccctatctactcgattcaaagggtcccgctgcttcattttttatcaaattgactcaagacgacagtttgatgacaaccatcaacttcttgaatgagtgggctctgttattgatcggcctaggcttgactttaggctgtttgtatcgtttatcttctgttggaggtatgattcttctcgctatgtacacgttatcccacccctctttcgtgggagcgagctatatgatgccgtttgaaggctcttatttatggattgacaagaaccttgtggagttcgccgctttaggcttgatgtgcgtattccctacatcacaaatcataggattcgatcgtgtgttaggacgtgtgtgtccgatattgcataaacttaaatttatttgatacccatggcaacagaagatgcaaagaatactccttctcaggagcaaatgcccgataaaggacgtcgggacacattgaagacattggctacagtgcctatcttaggtgctttggcatatggcgtttaccaaaaaaggaaagacgctttaagaggccgtaacatatcagatgtatttcaggtaagtaacaggcaggcctcctatttagagccgcaaggcgatggtaagaagatccgtatcggtttggtaggcttcggtattcgtggaaagcaattgatgcgtgccgcaggtttcgctgagccttcttggatcgataagatgaaagaggctaataagttgaataagaaagacacgcgttatcagcaatatatggagcaagatgatctgaatattgagataaccgcggtttgtgatatatttgatgtatatggtgaggccgctgtattgaccggttccaatatccatcgtgagggtagcggcggtaagttcgggcctgctccgaaacgttaccggacttatcaagagctggtaacggctccggatgtggatgccgttattatcgctggtccggaccactggcatagcacgatcgctatggctgcggcacgtgccggaaagcatgtatattgcgagaaaccgttatcatggacggttcctgagacgtatatggttcgccaagtgatcaaagagactggcgttgtatttcagttaggtcaccaaggacgtcagaccgattgctatcagaaggccgaggagattatcggtaacggattattaggccctgttaacttgatcgaggtttgtacgaaccgtaactctccaaatggtgcttgggtatatgatattatcgaaggctctaatccgaatacgatcgattggaaacagtttgaaggtgatcctgagcgtattaaggagtatatggattatatgacatccaataagcttgaaagatatatcggtccggacgagcgtagcaagtttagtctggaacgtttcttccgctggcgttgctggtgggattatagtacaggtctttccggtgacttgttgacacatgagtacgacgctgtcaaccagatcatgcatgtaggtatacctcattccgctacttcatccggtggtgtttatttcttcaaggacggacgtacggtacctgatgtattgcagactactttcgagtggccggatcgtgacttgacgatgttgtatagcgctacattggcaagtagccgtaaccgtggcaaggtgttcatggggcatgatgcttctatggaggtttccaatatcttggctattacggttgaccaagattccactcgttatgcggataagatcaaggaaggtattattcctacagataccccgttctatacctatgtaccgggacaaaatagctcggattccgttacatctcctacggagttgtatttcgctaaacgtggtttgctgtatacgtatgtaaatggtaaacgttatgatacgactcacttgcatatccgtgagtggctggaatgtatccgtcaaggcaagactcctagctgtaatatcgacgctgctttccaagaagctatgactgcccacatgggtactcgcgcttatctggaaggacgtacgatgtactgggataaggacaaagaagagatcgtaagaggtgaacttgcgtaagtatctaaaaagacgataaataactttcccaagaagcgaacttcataaatggatggagttcgcttcttttatttgtgcatgtataaaatttcttctcttttttgtaaccgatttgtgattactcatgtcttattgataaaagcgaataatttattaaacctttaaagaataaaagatatgaacgagttgtggattcctattttaggtgttatttgtgcggtaggtatgccggtattgttaggtattatcgctagttacatgaccattaaaagtaagcatgaggaaaagatggcgatgatcgagaaaggaattgtgttggaagaggctatgcgccccgagagaaggcctaatcgttataataccctgcgtaacggtatttttatgatcggtttgtcattgggtgtgattgtcggtatgatgctcgactctgctttcacttacgatagcgattggttctttttgttagttccggctattacgattatgttcggtggagtagcttttataatttatttctttctttcccgttctttaatggagaaggagagattggaggacgagaagaaaatgcgtctggaagaataaacgataccggatggatgagcgaaagtggatagaacgtattttggcaggggacacgcaaagtttctcctgccttgtcgcgaagtatgagaagatggcttataccatcgcttttcgtatcttggaaaatcgcgaggaggcagaagaggccgtacaggatgcgttcgtgaagatgtatcgtgctctttccgattttcatttcgatagtaagttctcaacatggttttataggatcgtgtatcgtacggcgttgacggccttgagacaacagcgtatgttcgtgagttatgaggaggcaggccctgtagacctttcgaatgacgaagttgaatcggctacggctttattagagcgtgaggaccggaaagagatgatcgcacgtacgctgaaaaagcttccggctgatgaggccttgttgcttactctttattatttggaggaatgctcggtggaagagatctgtcagatcactgaattgagcgcttctaatgtgaaagtaaaactattccgtgggcggaaacggttttatgaagtgttgcaagataaaatgaaattagagacagctgatttgttatgaatatgaatgagaaagatattgatcatttgacacgtaagttgatgcgagggacggcggaacaaccttcggcctcattaaactcccgtattatggcattgattatacaagagaagaagcgggtatataagtactatatcaagaaacgatttacacctgtaggcatttttagcatatttgtcgcttatatgcttgtgttagtaggcatcttgtatttggttaagctttctccgggcggggcggaaacggttttaggctctttgcgagcctatttcccgattgttttaacgattgcttccgggatctcttgtttcttcctgtttacacaactcgataactggttgaagagagaagagatacgccggcaaaacacctcaaaataaaaatatccggttgtagagacggggcacgccccgtctctacaactgattaattggccttgacttttagatttccgtaacgatttccttcgaagtgaatcgtcggttgctttccaccattaatctcataggtgtaattcttgtcacgatcctcatcgtcaaaatgcttgcgggtgatattgaaaccgttcacgtcgcagcttgaatacttcatgttctccgctactatccggaaagaagtttttgcgggaagcgctacctctaaattcccataatgggattctacgttcaccttcgagaaagagggagacaagttccgtatctttaagttactatagctaaggctacttacattcaatgcatccttaagggtcccgattttagcgtcgctgtacttaatctccatgtctagtctgcttacgctttcaatggtgagattaccatatttaatctccatgcgtaaagattgtatatcctgtatatccagattggaatatttgctgtctatcgttaaatctttagcgttgcgaatcttggcggttcctacgtagcccagatccagttgggcgtcctgcagatttcctacctcgatgttaccatatttggcctctatcattgcgttggctgtgaaattacccgcattcaggttgccgtattttacatggatatccatgttgccgttattatcgcttggcaagttgatgtttccgtatttctggttcaagtctgcggcgagcttaggaggcatctggatataataattgatcgtcatggactcattattcgaattgctattcatctccttctttatcgtagtgaccgctgagacaataccacctatcttcttggtctcgatttggatacggtccaagttctcttgagcacgttcctcgctgcgagccttacattctacctcaacccgtatagctaccgtattctgattccagtgggtaacggtgatgtttccataacggttttctacttggagacgatcaccggcgcttacgctgtaggattgggatatctcttttttcttgatcttctcttgtggcctagctattgccgatagattgcatagcagcaatacgaaagtcagcaatacggcgggactcaattttacgtgtgtcgtgttcatgattgatatgtattaattgttattactatttctggttatccgtgacttgttccatttgcttaagcatcagcgtgaggccctccaagctattgctgtaatgttgggtcatggcgaagagaccgtcgttggaacaaggcaaggtagggagtatcgtttcctcgaacatataattatccgtgaggatccgtttgctctcttgcaataactcctccgctcccggtgtccggtcctgtttatacaacttcttcatttgcgccaatacgtcgttcatttgcatattgtaatataggcgtagttcctcgatctcctcttgggtctcgcaggtctgggccgtggtcttttgcgcgggttccggcagaccggtcccttccggcaagcggaataagagcaacaaagcgatagaggcagctatggcaaaggccgataggctgtatagggccgcacggtttttccgtggcttcggcagcttttgctcgaaacgttcgaaatgaccttcgggaagcatctcatcttccttgaatgcgtcacggttcgcgtctatgaaattctttagtttatccatgtttaattggctgctataatgtctaacaatttccgcttggcgcgtaggtactggctacggacgcttggcggttgaattttcaggatagaggcgatctcttccatatcatatccctcaaagaggtaaagcgagaggattatgcggtagcctgccggcaacttcttggtagcttcctttatctgtgccacggaatattggatttcttcctcgtccggtccgtccgtttccggttcggccagattgtcggaaagctcctcttggtccggtgcttggcggcgtacataatcgatggccgtatggatggcgatgcgatgcatccatgcctcaaagcattgcccgtcatgatattggtccaagcgtgtgaagatcttgaggaacgagtcctgcatggcttcttccgcctcggatgagttgcctacgatacgcaagcaggctatatacaatcgctgtgcgtattgtttgtacaacttcagttgcgagctccggtctccccggcggcaaccctcgatcagatgttcggttactttgtccatttgtttatataaacgagagtgatgccttgaccgttgcatcttgtagcgtaaaaatacaaaaaaagaaaggcatcatctcgacgcctctcctcctgaactaaatgataaaaataaaagttatgtgggaaggtttatttcatgtccgttatattggagatactatcgttcgtatagccttgcgaagtatcctccattttggtcttatccgaattatattttaatttataagcctgtttcccttcggaagtccaatagtttacgacaagatcgaccgtctctcctttggtatccggcaaggaagacaaattgaacgccacacgtccggccccgatcgtatattggggatcatcgtaagcgttatgcctaaactccagcgtataaggatcattctcggcatccggttggatcaggttgataaagtgggcggtcttgcctccccagagtgtctcgaaatagatattcaaatatccgtctccgatccacatattattgttataaatacttaccgggtccgtaccatagatagaatcattagccgctccctcgttcttagcgatggatttcgtaaggatgttatggatcgcgttcaccttgatatagtgggagaaacctcctaggttactttgggtggaatccgccaatatcgtgaagttaaccaaggcacgttggttaggcttcggctgatagttcggatagttcgtggcggcgggccatagcttatccccgtcatccagccgtaagtaatatacgttattgccttccggtactacggtagcgaccgctatccagatatcacctaaagaatacgagttatcgtcatctaagcaagagggtagggtgagggatactaaagcgatcccgataaccaataaaaaagctctcaacgtcttcattccttttgtttcttaaaaagttcacatttcatcgttctatgaggaaagatgtaagttcggggtgaaatgctgcaaaagacgttaataaaagatgttaagaaccaagggattcaacgattagccgtgccgtacgctttgaagccccgggcattcctagcgtatggataatcttgtcgtatccgtctagcattcgttttcgataggctggatcttgtaggatgcgtcctagctcgtcttgtatttgcgattcggagaagcgggctccgaatagttcttgtacgatctcccgtcccccgatcaggttcacgagggatatgtatttcgtatggaagaaatgcttgaaaataaagctggccaactgtccggctacaacgtagtagcaaacgacttgcggaacccggaacagggcggtttccaaggttgccgtgccggaggttaccaaggcggcggcactatgttgtagcaagggataggttttaccgaacacgatcttggcaggataagagcctatgtattcttgatagtaggcaggatcgatgcctggtgctccggctattaccggctggtagtcgggatatgcggaggctactttcagcatggtcggtaaattatccttgatctcttgtttgcggctaccggatagcaaggcgaggataggcttgttggccaatccttcctctttgataaatgtatctttggggatcgcttgatgctccttgtaataggctacggagtctacagaaggatttcctacgtaatctaccgaataattaagcttccggaaaaactcggtctcgaacggcaggatgcagaacatacgatctacataacgccggaagtccctgatgcggtattgtttccaggcccatatcttgggggatatatagtaatataccgggagacccaattgggttttcacatatttggcgatcttcaggttgaatcccggatagtcaattaaaatgacgacatctggctgatagcggcggatatcctcttggcacgtcttcatgttatttaagatggtgcgcaagttcagcaataccgggataaagcccatgaacgccatttcccggtaatgtttgacaagggttcctccgacggctctcatcagatcgccgcccagaaagcggaactcggccttcgggtcattctctttcagggctgccatcaaattcgaggcgtgcaggtctccggaggcttctccggctatcaggtaatacttcatgaattgaaaattgagaattgaaaattaaaggatccagttgtttaaggtggccatgaagtcgtagtccgtaacgtcgatcttgcaggggactagggaggcgtatccgctgtccagcgcaagcatatcattgtccgggtggatgggtttggcgctttcgaaagctcctgtcaaccagaatacgggctctccgctggcgttctcggaacgcttgaattcacgtacccaacgaccatccgcttggcgacaaactttcaaccctttcacttgcggtagcttcggcacgttgaggtttaagtaggttccgtgcggtaagccttcttttaatacccggcgtgccagcatacgtccaagacggcagcattcggagaagtcggcatcggccgcatggtccagtaaggatacacccatggaagggacgttgaaaatacagccctcggcggtggcacccatcgttccggaataatttacgcagatagccatattccccccgtggttgataccggagactaacagatcgggcttgcgctccataacctcattaatcgctaatttaacgcaatcaaccggtgtcccggtgcaactatagatggtaagtccttcctcctttttcaacaaggtatacttgataggaactaaggatgtaatggcactacccatcccggaacgaggtccatcaggagcgaataccaccaaatcgcctagatctttcaggcactcaatcaattcgttaatacctttggcccatacgccatcatcattcgtgatcagaatcaacggtctctcgtttgtcatatcgttttatccttatagttgtcgtacaaaggtaacaataatttgcgaacaatggttggggtgtgaggggtgggagttgtcctttcgcctaatcagttgttgatcaggcgaaaggtctcagattattatagtttctctatttcttctatggagaggccggtggcaaaggcgatttgctctatactaactcctaatttcttaagattaagtgctatggagtgtttctcttcctgtcgtccttcagcttttccttcggcttttcctttttgcaatcctttttccatgccttcttccatcccttttttcatgcctttctcgacggcgaagtccaaggtgttataataatcattatacatcttccactccgcctcgtactgcgcccgttgtttgggggtgaggtttgccatcgatccgatgcgctccagtcgctcgaatatggccttgcgtgccttgaatggcattctgtctaatgtgtccatatgctttagtacataaatccaacgttcaaaatcagtctcgcattcttcctcctctttgttgaatcgaggaagctcaatatagatctggcggaacttggggttgaatacctgtccggtctctcggtccgccagcacgatgtcccttcggaactttccttcgttcctgttattgtttggcctgttcttctcatccagcgtgaagttcaagaagaagacaccgtacacggccgccagctcatagtcccatgttccctttatcccctgttccaccaccgagtgcgagaggtaatacaaggccctgtctttgaagtggggctgttccctgttctgcatctcgattatgatccgctcgcctttgtcggtctcgcaatggatgtcaaagatgactttcctaccttgctctgtctcgggcaatcgctcattgttcatgattctcaagtccttgatcgtatgctccccttcgaggaggtcgttcaggaactcaattaaaatgtccttgtccatttccctaccgaatatatgcttgaagccgaaatcggtgaagggattgataaattttcccatagtgtttataggttttagtgattaataatgaataatagtataataagacggggcaccctgtcttccggttgtaaagatactacttttttaataggataggcttcgttttagcttttaagaaaacacgtacgagttttttcggaaacacgtacatgtttttcgaaaaactcgtacgtgttttttgagaggcataatgtaactactttaaataccggatcagccgataaatcgtggggataattttcttgaatgtatattccaccaagggatagtatggctaggcactacacgatctgatcatttcatattcgtgaagagatcttttcacctacgtgatacaatcgtttcgcataggtgaaaagattgtatcacaaccgtgaaacgatttcatgggcagatagagcaagctactgccgataatgtttgtattaaatagaaaggctcaacggtaacaactcttcgtaggcatctctgcgctccctttcacatccttcacaacatatcactgacataaagcaagttggccgacgtgaaacgtgtgataaacaaattgaagtgtagataaaagtacattgcgagattatcctcactatttatcgggtgagcctgaaaaagtcgattctccgggagttaagaatacaaaatgtcaaagtgttactttgatatagatatacaatgtacgcatgtacattagtatatgatagtaaagtttgtatgattaataaatgcttttctagtatagaaacgactagtttaaacgatcgattcttttagtcatttgcaaaggtacgcatttcttcgatacttgcaacccttccagacgatttttttatcgcttattctctttcttatcaataggataggttatccttcacgaaacaagcgattccttcaacaaacctcccgtttcgacgctcaaaaaacgcaagatttagacgatcgtttagactagtcgtttttaatggcaaacgacgattttcaattagtctaacaagttgattatcttaataaacactagtattaatattaatttatttattatgaacaaaaagatttctacgcttcttgccggtgtaatgctggcatctgcgttctctgtcaatgctgcgatggagaatggcaaatcttatttgctgaagagcggaagtagttatttgtccgctgagacagataagacttctgctgattatggcaaacttgtgtacggctcacttaacactagcgatttgaatgaagttgttgccggtacttggaaagtttcaacaaagactacttctggagctgttgtctacaccttcgtaaataaggtgacaggaatgacattggctgttgatcctactttggcgaaaaccgcgaccaacggtctttctggtgatgtgacattaggcagtggtacggtttctgaatgggcattcgatgctagtaaccacatgtattcttacttcaaatcggactcaatcgttttctttgataatacgggtgccctgaacaaaggtaagattgcggacttgtctgctgctttggctgttacagaagatgtaataagcactcctattccaataagtgcagatgatttaaatacattgatgtggtctgttgattctaaagacaattattttgcgttgaatatggaccctgaagtgtcaaaaggcaaggcgaatcatttgacagcgacaggacttcaagcggttagtgctggtagtggttatgttcaattgaaagctaaggacaaaaaggcggatgacaaacaattgtatgtagttgtcgatacggcttattatgaaggaactgagactagcggtcagttgttgaaatatacctatgacgtattaaacgcagacaatcgcttgactggttcttataagttcaagttcacttataatgtgaaagaagacaaactctatgttcaagtagcggaagttgcggataaattagtgaaagcatcgggtcaaactgacgagcagtttgcgaaggatatcaaagacaataataataattcttattggtctaatcaaggaaaaactgtaacgacaagatctgacaagtacatctacatggctaaattggacggtacgaatgtgttgacactgaatacgaatgagacggatggtggtactcctacctttgcttcacagaatattacggttaagacttctgctgactatagtagccttacattaactacgattccttctggtgtatacttgatccagtataaggctggtggttcttacaatacagaaaaggtaggttcttatgtattcgctaatttggctggttatttcggttgggctgctcaagctcgtaaccaagagttcaagcatatgccggctgctcaatgggtagtagagaagaaaggtacatcttctattgcgccgatctcaattacgaaccgtgagttctctgatgatagctataagacttcttatcaaattccttctgatatgcaattattcgcagtagagggtagtgctaatgaggtattctattttaatggaaaccaaaaggatacggttagctttattaaagttgacgaggatcttgtaaaggatgctaaactgggatataagtatgtatcagaaaatgaagctaaggttcaaacttatctgtttaactatttgcatggattggcattagataaatatcttaatgttccgtcagggaaggattctattgtacgtgtagatgagactggagctaaagcaagtttccgcttacaagtggttgttaaagacgataagtatggttatggcgatggtttggtaagaaatgtttaccgtatcacggacggaaaaggccgttatttgacttatgacgggacaacgaagaagtatatgatgaagacttatcctactgattatttcttgaaagagaataatgatatcgaaggaaaagaatattatactttggttgaggctaatttgcttaatacatctatgacacaggcgcaagcacaggcatggtatccagaatggtgtaagggtatggctgtcgcagatgcaatgactatcgaggagcaatatactccggagggaggatctgctacttatgtgactgttggcggaacctcttatttggcttatccgggttcttctgatattgttgctgtagcgatgtatgataaagacggccaacgattggtagatgataatagtaaggtagactactatacttatcagaatgttaatggtaagattgcgttgaagaaagtaggagctgctcaatatgcctctagaaattacgcttcagtgaaggtctctgttgacgacaatacgttggatttgactcgtggctctttggatgataaattctatagcaatcaagagattcgtacatctgcttttgccgtagcaatggatgattctcctttgtatcgtcgcttcaacaacgccgctctaggtgagaatgtaaatgacggtcctgatagcttgacattcgttgagagcgttcgtaatgagtacttaatggatgagtggaacccgaacttgactacggaaactgttgattacgctggtatctggaataaggataaggctgagggtaaattagcgttccgtattgatacggcttggttgaatcgtggtcttggaaatatcaaacctcaatatttgatctccgtggctcgtgacgaccaagagggtgttgagacagttccttgtacagaggctggtcctcacgttgacgctaacggtaacattacaacagatccttctaagtgtgttcatgctcaacatggtcgtgctggcttcgcttatggcaaatacttggttaacttctcagactctgcccaagcgttcatcgatagagaggctaaggttaatccttatatgttcacaacgaattctagtgctaatagcagctatacccgtgtaggttttgttaaggctatccatgctggtgacagcttgttcgtattgacaaatggtttcgagaatgtagaaccggctaagttagatacggcgacaatcatcgctaactataagaaagctaagctggaaaacttcatcgtagacttggttggtgacaaacataagaatgtaacttggtcattccgttatattaacccggataaggctggtgccgtaacagaagaaggtgcagagaacgcattcttgttcgagtctaatgtttatggcgagaaagatcaaaattatagaaccgtaaatggtgacgctgatcgtgctatcgctccgacatatgctgccgcatggttgaaaatgcataatggttgtttggtactgacagatatcaattcacagttctcttccgcaaagaccaatggtgatggcgcattaatctttaatgtcgctcagaaggatgaagaagatatggttacatctaatgataacatcaacaatgttgaaggtgtatctgtagtagctggtaatggtactgtaactatccaaggcgccgctggtaaatcagtagttatctctaacatcttaggtaaggtagtcgctgagacggttcttacatctgataacgcaacaattaccgtacctgccggtatcgtagctgtagctgttgatggtgaggaagctgttaaagtggttgttaaataattaaacaaatagataggtcaagagatggggattcccccatctcttcctttaagaagatatttataattctgaaattcccgtgtggagatagattcttcaagtacaccgcgatggtagaacatgcgggagtattaatactaaagtaataaattaaaagctcaggtcacgagaacttctgtgaagaaatgtcgtgacctttttttgtactcttaaatctcgtgctatgcttatatctactcaagaaacattgatctataaatcaattagtccggaagacatttattgttatactcccggaatcaccgtgacttcgacgggacgcttggtcgtgactttcgacttgggcggcaagggggtaaaagaaatctatgcttcttcgcagctgtatacggaaaggacaagacggttaggtatcggtaagatttttgtatcggacgaccaaggcgctagttggtgttttatctcggattttaatttttggcatgcccgccctttttgtataggggaaaagatatatatcataggaaacgcaggcgatttatgtattatatgctcggaagatgatgggaatacgtggagcgttccctcgtttctctcccaaggtgagaaatggcattcttctgcctgtaatgttcttttcgctaacgagcgggtttacttggcgatggaacagcgtttttataactcggagatagaaggctggaatgtggcgggtttgagccctaccttgctatcttgctatattcacgatgatttactggatgcgtcttcttggcgacgttccgatccttttgttttcagggataaagtacatttcccggaaggggttggcattcctttttacgagtcattgaccaataagccgctagaattggctcccggtcgttttaatgcgcccactggatggctggaggctcaagtggttcaaataaaggataaacatcatatttggtatgatccggaagggaaaacgttccatatgtttcttcgtgcgcataccggagggattggatacgcttgtttattaaaagtgagggaagataagaacggccagatggtaaccggctttcaagagactccttccggacagaccttgcttttcttgccctttcccggtggccatttgaaattctttatagtgtatgatgagatatcccggttgtattggatggcatccaatcaatctttcgattctatgcggacgataagctcattacctgagacttcccggtatggactcccgaataatgagaggcatcgtttacaattattattctcgaagaattgtgtggactggtgtatggctgggatgatcgcttgccaagggaatgaattatattcaagaaattatccttcgttatgtatcgtaggtgaggatatgcacgtggtttgccgtgcggcggatgatcatacaaaggaccctcaatactctgattgtattacatattataaaattaaacggtttagaatgttaatctattaaatgaagtgattatggaaaaagtactgattgtaataccggctcgatatggttcaagccggttgccgggtaagcctttggttaagattaaaggtatagagatgataaaacgggtctcggatatagcggattttgtatgtcgcaaaaatgagtcttgttcttatttggtagctacggatgatgagcgcatcgtcttgttttgcgaatcccgggagattccggtgatgatgacttccacgaattgtaaaagtggtacggaacgttgctatgaggcggtaaggaaacaggacaccaatcccggactgataataaatctgcaaggcgataatcccacgtgtcctccttggatattgcaagatctgatcgatacatggagaaaggagaaggcggatgtccttaccgcctcggtcttgttgggatggagcgaatacgatcaattactggcgatgaaaaaggaaaccccttattccggcacgacggtattggtggatcggctgggatatgccttagctttctcgaaacaaaccatacccgctatccgtaaggaggatcaggctagggatcttttgcctaaaagccctgtcaggcggcatgtgggtttatatgcgtatagcggtcgagccttcgagtcttatttctcattacctccgtctgtgtatgaacgctcttatatagaaggattggaacagatgcgtttcttagagaatggcatcaaaatgagggtcgtagacgttgattatcggggacgtgagacaacaagcggggttgattccccggaagatgtcaaacgggttgaggaaatacttgagaaatatggagagttcgatctttcgtgacttagatggaatcgtagattctattttatttccttaccatactttggaggaagttctacctcctggctgtgaggctggtccggtatggatggaatttgcctgttgggtagacagccaaaaggtggatatacgggcatcggaatcacccttattcttgaatatatgtggtatacccgcatccggtaaatcgtattgggcggaggaatggctatcagagaatggaccttgtttgcatatcgctttcgacgctattatggaggcattatccgggtatcaagcggattgctcgctagatagggagaaagcgttcttacgttgggaacttcctgctcgttttttaggttaccgtcttcttttgttgggattgaggaatgggtggcctattttatttgaacatagtaatgcgttgagagaacatgtggatttgtataagaagataaagagtcttggatatcggattcatatggtgtgcatcgatgcgacaccagaaatggttatcaaaagattggctcggaggaatcgttttttcccggaggagcaagtaaaaaaacgttgggattgcttgatagatttgttacctgaatatcaaaaaatagtagatgactttaaattaatacaaccatggaaaaatgtagaaaacttgtgatcgtacggcatggtaatacgtttcgtgcgggagagactccgactcgggttggagctagaactgatttgcctctggtagaggaggaacgagctagatctgcgggacgttatttacgtgaaaaggggattgtgatcgacaaggtgatttcggcccccttaaaacgcacattggagaccgctaactatatcttggaggaaatgaatgtggatttgcctatcattcaagacttacgtcttaaagagattgattatgggccggatgagaatatggtagaagatcatgtaataaaacgtttgggatctctctatttagaaaaggagggaatggaccggaaagacctaacggaagatcggatcgtggagaggggactttccgtgatcgcccaatggaatgagaaggccgtggtaccgttaggatggaacgtagatgtagagaaactgataagcggttggcaggatttggcggctagtatacctgatggtgagacttggctgctagtatcttccaatggagtgatgcgtttctccccctatattctggggaattatgaggatttctgtgcgactcatgatattaaggttccgacaggtggggtttgtatattcgattgtgtgggtgatcattggaggtgtacggattggggaataaaggcttataaactttttaaatgataaatcatggaagatatatggaatataacagctttggtagttagtgtattaagtgtgcttttgtctctttatgctttaagacaggctaccactaaaaatacctcggatatgtatctgttctttatctcgcaatatgcgaaggaggacatgaaattggctttacgtaaattgaaagatataaagcggggggtatatcggttggaacaatgggagagtgatatgaaaaataatttgccgaaagcctttgagtatgacgaggcgagacgtttggtgaaatatttttatgatactttagcctatatgaagttagagaaactgatagaggcacgtttcgtaagattgatttgcttgaagaaaggagcatggctttatctggatacagtcgaagccatggaaaagttttttgacagtggctatgataaaaagccatatgcggttattcgggatgtatgcgaaaatttacgaaaggaagggtgttgtcctccttagttcattattttcggcttttggtgatttaataaagccttgatcgaagaaacgatcggggcttttatatttatttcttaattcgccatgacgatattccgcaaatcgaaaccgaattgaatatactcatcctcagtgatttgcctctctgtagtcaggatgattaacgcatgccctcgatagttgtttctgtaagggggatggaaatggttgtaacggttttcgaagaagccgcattttttatagaactttaatcgcttggaggaaatttcatccgtaataggatcgatctctaataagatgatcttattcaggcgtttattaaaatcctccagcaataaaccgccgtatccttgtcccctaaagttctcatgaatggcgaaatgttcgatatatacataggtgctaaaatcccagtatgagataaagccgataaagaggttatctttcagataagccactagatgatagttgggagattggaaggcctgttcttgttgttcttctgttcgttgctcaaatagagggaaacttgccgtatatatttgctcaaaggtaggatagagaggatcttgcttttgcgttatttctagtatgtccatatgacttcgctttattttgatgcgaagataataatctaaaaacattgtcatgtcatattaaagctttatttttggatgatcttataattaagatattgtatacgatgatagcgtggtttcgttatatatgtttaattgttagccttataatcactatgccggaattactttcggcacaacgtctggtttctcaacgtcaagaggatgtagaggccggtcttttatataacgagagcgtctacatcctatctaattattcttgtctatcctccaattccccggaaaaactttctttggacgagttgttgcggaagcagatcgaaggcttttatttctatttgaagcgggatacggagacaaatgtattgttactaaggaaacctgatggtacgtttaccccttttagtgagtcattggaagccattaagacggccttggatgcggactccactaaggttatgacgcttttccttgatttctatgtagagacggagctggaatcctcttttaaggaaataggcttgatggagtatgtacttgagtatgatacgaaaaacggatggccatccctgaaggatatgttgagttccggaaagcgactggtcgttttcgaggttcagaaacatttgaacagtccttcatggttgcataatatgagggatttcgtggagcatacggacgctgattggggaaaccaaccggaaggggttgagagttttgatgagcggctgaaaaagaatttgtctttatttaccggatataagttcttggagacttcccgggggaatagcaatgatatctcggctttagcccggcagacgccctatttaattgaatcgtttaaaagagcgtggatccgggatggaagggttcccaattttatcttggtagataagtattacgcatggttggatgtctcgttggttacttttcggaatttcgatatcatctacggcgcggttacgaataacaatgagctgcttaactacgtgaattgggatgggatgtctaattatacgacgggtaaatattgctttccgctagagcccggagccgagttgatgctttcgccgatctctccgggctatcggatagagccggctacggtttatgtctccggtacccaaaggaaggctttcgccggcgattttaaggctagacctttgcggattgacgaggatatagagatttatttaccgtttgagggcgatgagaaagatggttcgtccaatcataatctcacggtatctaggaatgtcgagtttattcaggaccctatacgggggcaggtcgcttccttggagaatcaggcccgtgtggatttgccgaccgcttcggaacttcatatgcgggatcatgatttcactgtcggcgtttggttgaaaatacctaagtacctgccggagaaggaggattattgtattctgggagctaagaacagtacttatcaacaagcgttgcatctgttgatacggaatcggaaaccgtatatgggattctttaacaacgatctggttggtaacacggagatcgagccgggcaaatggtataatgtcgtatggcggtataataagcggaatggggagcaggctatattcgtaaatggaaaactggatgcgatctcttttgatcgtccggcttatctgggtagtgatagcttatatgtcggtttcgtgaatttcagccagtcctcgaacttcgtgggtgtgctggataatctttgtatttggtctcgtgtgttgagcgataaggagatattgggattgagcaaccagttattagatttacatatatcgaatgcgattacttggttggatgtccttggaattgggttgattttgatggttctggtctcgatagcttatctaggctatcggaaggtgaaagaaaagccaaggcaggatgaggctgatgcgggaacggttgcggaggagggaatcgaggacggaatcgaggagccggatcgttcttcgcaagagatgccggaggagatcgagaaggttccggttctgcgcaattatatccgattgtttggagagttctatgtgttggaccgggatggaaatgatataacctctctatttacccccaaattaaaacagctgtttatcttgattatgcttcactcttcccgtggaggtttcggaatatcgagcaaggacttgacacggatgatttgggggaatgacaacccctcgaaaagtacgaagagccttcgaagcgtatctatattgaaactccggaagatattggaacgtatcgatacggtcgaggtcctatttaacgcgaatcgatatattctccagctttcggaagatgtctattgcgattatttggcttgtttggattggctgaaagataaacgggtacggactcagccggactttgaatatttctatgatattatcagcaaaggagaagtgttcaaaggggaatcgtttgattggatggatgattttaaaagttatatctgtaatagtacggtggatgtcttgtctcgctttatcgacacttactcgatcgaggatgaggcggatcgggtgatccagatagcagaccagatccttctgaacgatccttgcaacgaggaggctttgctctataagatcaaagccttgatttaccagaacaacttcaaattggcccgttacgtgtacgaccgcttttgcgctttataccaagagatgtatggcgaggctttcacctcttcttttgagcaggtcgtaccgtcttcgctgatgagtcagcaatctccccagtaatattatagtgtgcctgctcattggcagactgtgccatcgctattgtcacacctgtgccatcgttgtggcaagaccgtgccaccgttatggcatgcctgtgccatccgtgtggcactcctctggcattacagtgacaaatgtatgcaccccactgatagcgatcctttcgaatagggaggcaggtgctatgcctctgacttatcgaagatttttataaatatttcttgatttatttatgtcgctgttattgcgtgaattatgctttgtgcggatatgaaatttgccttaaattagccctaggttaatgccttgtttagcgttcgttaactcatggtttactgctcctccctatattcgctctcgttgtttcgcacgaggaagcgaagttgtgttttactatatatatttttttttcgactttaaatttaatactatgagtaacactatgtctgacaagaattcggtgaacttcacacgtagggagttcttaggtacagtagctgcagcggcggcgtttacaatcgtacctcgttccgttttgggtggaccgggctatacggcacctagcgatatggtcaatttggccggtatcggtgtgggtagccaaggtggtggcgatatacagaatatcgctactccggatgtacctattaaaaggagatcttttggtggaggcggtatgctgatgcaaccttatgcgggcatccagccacccagacgggaacgaagagcgtcggataatcctgtgcaaatgggagatgcggagaaacaatcgtttaagcatgcgaatatttatgcgctatgtgatgtagaccacgattactccggacatatcttagcgggatacccgaaagcgaagaagtataccgatttccgggaaatgatcgacaaggagaaagagatcgatgcggtattgatcggtactccggaccacacccatgcggttattgccgcttatgcgatgaaagcaggtaagcatgtatttgtagaaaagccgatggctaagacgatttatgagacccgctttttgagggatctggcaaagcaaaccggtgttgttacccagatgggtaaccaagggcataatattgaagggactatgcagacggtcgaatggattcaaggtggtgtgatcggtgacgtaagggaagttcatttgtggacaaaccgtccgatgtggcgccaaggttattttgatcgtccggcgggagtggatataccgtctaatcttaactatgacgtatggttgggtccggcccctgataaaccttataatccggagatgcttcatttcgcttggcgtggattatgggattacggtacaggcgctatgggggatatgggagctcataccttcgacgctccgatttgggcgcttaatttgggtatgcccacgaaaatacaagctacttccaccccttacaataaggactatctgccacaatcggaatgcgtgacgtatgagttcccggctcgtgggaatatgcctccggtaaaggtaacttggagtgatgggggtataaaaccggctcgtccggcggagttggaaccgaaccgccagttaagggaagcgctttatataggcgataaaggtctgatcatgcatggtacccatggagcggagccgcaactgataccggaaagaccggggttcgtagctccggcgaagacattaaagcgaccgagtaatatttatgtggattttatcgaggcgataaaggaaggtcgcaaagccgctaatgattttgaggtatccgctaaattgacggagattatgttgctgacgaatgtcgctgtcgctgcgcaacggttggatcttacgttggaatatgacgcagagaatatgagaatcacgaattgtccggaagcgaacgattatttccactatgagtatcgtaaaggctggagcctgtaagggactttcttctaagggttaagattaatttataaattgaatggttatgaataaagatgtgaacaatggtcagtccagacgtgagtttctaggaagatcggtcgctgctttggcggccgcgtctttccttccgagtgctttctcttgtacggggaagagtgtggcggctcccgctccggttgatacggcggcggaggcaggcaaggttaactcgaagttcggtggcgtgcaaatcggcacgatcacttatagttggcgttccatgccgggtggattggagaatatcatcaagtattgccaagaggcgaatatcagttccatcgagttgatgggaggtgatctggaagcttatttaggagctccggagaatccgatgatgaaattcttccgtcagcaagctcctcaacccgcggcgaaaccgggtgagaaacctgcggctcctcgtcggatgggtcccccgaagtttactccggagcagcaggctgagatcgataaatataaggaagaggtgaaagcgtggcgtctcgggctggatctatcgaaggtggaaggtgcccgtaagttattgaacgaagcaggaatatcggcgcatatcgtgaagatggaaccttcccgtatgggttcggacgaggaaatcgattatgcgttcaaggtagccaaggccatgggcgctaaagccgtgacggacgagattaatttggagacggcgaaaagagtcgctccatttgccgagaagcatgggatgtatatggctttccataatcatatgcaatatgccgaagaaggctttagttgcgatccgatcttagcggtctctccttctattatgttgaattttgacgcgggccacttctttggctctacaggtatccatccgaatgagatgatcaagaaatatcatgatcggatctatagtatccacttgaaagataagacggggcctacgacaggggaccagccgaatacgaatcaagtatggggacaaggggagatgccgttggaagacgtgctcttgttgatcaaacaagagaaatggcctatctattgcgatatagaactggaatatgatatcaagccttggtctgactccgtgaaagaggtaggcacttgcgtgaaatatgctcgacaaatattgatgtagattatagaatgttgtctttggtatgtcattaataggtataacgaaagggccggttcctgatggagccgaccctttatttttcatttattgatctctttcagcaaattgggcgcgcacttaaaatggacaatggttctggggatcaacattaaagtctctccgcttttcgggtttctagccaacctgcttgtctgcaagcggggagtataaacaccgaaaccctgtatacataccttttctccggctctcgttttctctaagatgatgttattcagttcttccaatatgtaccggatttcttctttgtcattaccgactcttttcgataattcctcgattagctgacttttattcatatcgtattattttttgagaagtttgttctttgctctgttgttaaatattttttcctgtattgcaaaggcgataagcccgtgtgcctccgaaagaagcgtcccaacgaagattggttcgagaactgcgtcttctcaacaatctcttggatattcaaggtagagttggtgagtaatccttttaattctaggatcatatattccgtaatccaatctttggcggatttgccgcttacctccttaacaaccatggtcaagtatttaggggtgatgcatagagagttcgcgtagaacgtcacgcttctgttcactttgtaattactcatgaccaattgaaaaaatttgtgggtcagttctttcttgtgtacatctatcgttgccgtactgtctaaagaattgactttataatggttatatatatcaaggaataatatgcgaagtaagagtataaccgactctcttcgatactggttttccggatcgacggcttttcttataagtaattcaaagaagtctacaaaggaaagagtttccacgtcttccatcttgaaatagtaatgttgcctcatatagaaaaagaaatgtggcgagaaacgactgataccgcttaatatatcagtataaaaggattccgtgatcgtgaaatatctgatttggaaatctacgctaacgtccgttaatgcgaccaattgccccggcaagatgatgatgagctctttaggggttataatgtgcttgttggaatagatatcaattttagcgtttccttttacacaatagatgacaatccctaatcttatataagaagggtaagtggtaatagggagttctttggaaagtgtaaagatcttgaagtccttctccaaagaataatcaataccactattcggctcaactatttttttaatatttcccgacattctttttgtctatgtttcttatgtaaaattataacttcgtcttttactatatttatctagtggttgtttggtataatattacagaaatataggtctcgttttggcgttttttaaagtttggtttaaatgataccttgaaaaataaccgctattggatgtttttgtttgtaggtctaatacttttttgcaaatacggttgaggtgatgttagggataacttgtattctaagggctgtgcgagctggatggaatatgtgttaggaaatattagtaattcaggttaaggacaagcgtgcgagacaagaacgggaaggattgcctcgcacggcaggcttaggtcgtcttttagataaacttgagtatatcttctgccttttccgctatatgatcgggtgcgtatttctctaattccgtacgagggcgaaacccccatgttaccccacaggaggtcacttcgctgttgatggcggtttgcatgtctacgtccgagtcaccaacataaagagcgttctctttggatatgctcgctcgttctacgatctcattgacgatactgggatctggcttcgcctttactccttcacgctgtccgagaacctccgtaaattgtatggaagggaagaaatgggcgatgagcttacgggtagcggcttgatatttattagaagcgaccgccagttttatccctctttcctgcaacaaggctaataactcagggataccggggtagggaacgctgcgatctgtgttatgcagatcgtaatgcttcaagaactcttcccttacctttagtatattctcttccgtcttttcaccttcgggtaacgcacgttcgaataatttgttgatgccgtttcctacgaagaagttatactcctttacgtcatgtgtcggaaagccgttttgccgcaacgcatggttcgtgctatgggctaaatccgcgatcgtatttaataatgttccgtcaagatcgaatattactaactttttcattttagttttctggcaaaattaatggaatgtagagatatactttccctttcgactgataaaatagatgaaccgatttaaaaatagataaaagtattaggtcatatataagatatttgtatctttaggacaggaatagaaatcctttgtaatatattgtataacctaaaattggaacatcatgggaaagaatcaattaattcacgggaatgaatttcatttgctgaaacaagctgagattcataaagctacaggtaaattagtcgagtcactaaacttggcagccggttctacgggaggttttgatctttataaagttgtagaggcttattttacggatttagagaaaagaaaggagatcaatgatttgttgggtatttccgagccatgtgagacacgtgtcacggaagaatgcttttcttaaataagccgcagtaggaataacatagaaaaaggagatacctgaatcagatatctccttttattatatctcaaagaaggatcaattacttaccagaaagtttttctttcaaagctgccaattcctcgatgtcacctaatgtagtcttttcaaccggaccggttaccattccagattcctcttcttttttaccgccacgttttgaggaagccttcttttcagaagttgccttagcgcctttttgctcatcttcaaagatgcggctgtgagaaaggatgatacgtttagcttccttgttgaactcgattaccttgaatgaaagtttctcatctacttgagcttgagaaccatcttcttttacaagatgcttcggagtagcgaaaccttctacgccgtaaggcaaagagataacggcacccttatccaatacttcgatgattgtaccttcgtggatagaaccaaccgtgaagattgtctcgaatacatcccaaggattctcttccaattgcttgtggcctaagcttaagcgacggttttccttatcgatttccaatacttgaacctcgatctctgctccgatctgagtgaattcagacggatgtttgatcttcttcgtccaagacaagtcagagatgtggatcaagccgtcaacaccttcctcgatttctacgaatacaccgaagtttgtgaagttacgaaccttagccgcatgacgagaacctaccgggaagcgctcctcgatgttttcccaaggatcagccttcaattgcttgataccaagagacatcttacgctcgtcacgatccaaagtcaagattacggcctcgatctcgtcaccaaccttcatgaagtcttgagcggaacgcaagtgctgtgtccaagacatctctgaaacgtggatcaaaccttctacgcccggagcgatctcgatgaacgcgccatagtcagccataacgacaactttacccttaaccttgtcaccaaccttcaagttcgtatccaaagcatcccatgggtgcggagtcaattgcttcaagccaagagcgatacgtttcttctcgtcgtcgaagtccaagataacaacattgatcttctggtcaagctgaacgatttcttccggatgagaaacacgtccccaagaaaggtctgtgatgtggatcaaaccgtctacgccacccaagtcgatgaatacaccgtaagaagtgatgttcttgacagttccttccaatacctgtcctttctccaatttggagatgatatctttcttctgttgttccaactcagcctcgataagagccttgtgagatacaacaacattcttgaattcttgattgatcttaacaatcttgaattccatagtcttacctacaaatacatcgtagtcgcggatcggcttcacatcgatctgagaacccggcaagaacgcttcgataccgaatacgtcaacgatcataccgcccttcgtacgacatttgatgtaacctttgataatttcgtctttttcaagagcctcgttaacacgatcccaagaacgtgtagcgcgtgctttcttgtgtgaaaggatcaattgtccttttttgtcttcttggctctcgatgtaaacctctacctcgtcaccaatctttaaatccgggttataacggaactcggacataggaacaacaccgtcagatttgaaaccgatgtttacaacaacctcacgtttgttcatagaagtaacggtacccataaccacttctttgtcttttaccgtgttcagggtctcgtcatacgtttttacaagatcgtccttgcttacttcggtgtaagtctcgccttgctcgaaagcgtcccagttgaaatcttcaaccggctggatgttttttaaattttccattctttaattgttaatactaagtttgttttaattagtaagttagactttatgttgtcatctctcaaaaatcggggcaaaggtaatgctttttttctgattgacaagagttttgaggggtaaaaacattcaattgggccgtgttggctgtaattacggaaaactgttgatttttattgatatttattttgtaagtttgcgaattgtaagcgataaatcaatgagtagaggatttttaagaaagtccagcgtcaatacttttataggaatagtgtggattttgtttgcggtgagcgcaagtgcgcagaatgccgtgagtaaatttcgtgcggatagcatacgccaatctttatcgtgtatccaaaaacctcaggataagataccccttcttaaagaattaatcggcttgtactggcaattgccggaggaggtaccagcgttgaaagagataatcgatatcgcgatgcctttggattccatcgggatcgtatacgatgcgatggctggcttgagtcgttattaccctgctattaacgtttgtccgagtcgggggcgctcttgaaacagtatgatcatttattggattccttggaaaggaagtataatggggagggaaagatttttccggtaaaacgtcatcgttgcttgatgagttgctattattgcgagctgtataccatgaaagggaattcgggaaaggcacaggcgtatttggatcaggcgaccgcttatttggatagttcttttggggatagggtggaggctcaatatctgcggacaaaatcattttattattggaaggagaaagattataggcatgcgttgtccgccgtcaatctggctttaaagatcaatcgtgatctggataagttggagatgaagaaagcgatattgcaatcgtccggccaattgcaagaggcggtcactatctatgaggagatcatcaataagacggagacgatcaacatggatgccttcgaccggcaaatcgagcaactccgtgtattgaatgacttgaatgacatggaaaagcaagatcgggagttgaagctgaaatcggagcaagaagctttgaagcagaagcagattgtcgtatctatcggtcttctattggtcttgatgggcctactctatatgttgtggcgtatttatatgcatactaagcggttgagaaatgagttgcttcaggagaaagactccttgatcgcttcggagaagcaactgagggtcgtgacgaaagaggcggaggcggcgaacaagaagaaaagcgcatttatcgccaatatcagccatgaggtgcgtacgccgttgaacgccattgtcgggttctcggaattattggcgagtagcgagtatagcgaggaggagaagatccggtttgccggggaggtgaaccatagttccgagttgctattgaatctggtgaacgatgtcctggatttatcccgtttggaatccggcaagatcaagttcagcgtgaagccaaacgatctggtcgcctgttgccagagggcgttggattcgattcgccatcgggtgaagcccggggtccgattgacgtttactccctcgcttgaatcttataccttgaatacggatgccttgcgtttacagcagttgctgactaacttgttgtcgaatgccgctaaattcacctctgagggagagatcaatctctcgtttaccgtggatgagggcaaggaggaggtccgtttctccgttacggatacgggctgcgggatcccggaggataagtgcgaaaagatattcgagcgttttgagaaactggacgactttattcaaggtaccggcctaggactatctgtttgccagatcatctcggagcagcttaatggctctttatcggtggacatctcttataaggatggagcccggtttgtctttatacatccaacgaatttaattgagacccccatatgagacagaagaatcgactcaataactggatatccatacgtatggggatggtcatcgtgatcttcctaggcgtatcttgcggttcgatgaaatcttccacacctcctcccgccaaggatcgtttaacggagatcgacagcttggagaggttattgccggactgcccgacaatagcgtctaccttgcccttattgcggaggttggcattcctgtaccagcagcaatccgagatgaaggtttataatgaacgtctttatgaaaatgcgatggcggtggattctatatctgtcgcatacttgggattgaagaacttagccgaatattattacgatcagtctgtacgtgatagtttggaatattattgttctctcgtagactccatagccaaggcccggcatgaatacccgaatgtgttgtttgacgtgaagagcctttcctgccaagatctcctttggcttgggaattatgagctgacgatgagcgaagctatggatctgtatcggttggcgagcaacttggatcatagatatggcttgctccgttgctcggagacattaggattgatttaccaacgaatccggagggatagcgacgctgtcgtctcttttcaggaaagccttgatttattgaaggatataaaggatgtgccggatatcatggatactaaggtccggttaacttcttatcaattggagagtagcgtacggacgaagcaatacgcgtcgacggaacggatcttagggcaatataaggctttgctcgatgagcagtataagatctaccaagagaaaaacgatcttttgtctattaaaagagaatattggttactttattctttttacacgagtttttatctttcgcaaggagacttggagaatgccaagcgttcgttggatcaagcctcttcttatgcggatagtaattgggttgagggagattatgcgatcaatacctacctggcggttaaggcccgttatcataaggcggcaggagacattccgctggcgcttcattgtataaatgaagtgctggagaccgagcggctgcccgaggatatccagttcaaggcggatatcttgaaggaacagggactacttggggaggtcatggctctatatgacgaactttatagtacgctgacgaaaaggcggggaacttcttttctccggcaggtaaaccaattgcgtaccttgcatgagctgcatgaaaaggagttgaaagaaacggaattgaaggaggccgggcaacgcatcgcccggaaacaggatctgctgatctttatcctatccatatcggtcgtgctgttgatccttctctatgtcctgtttttgtactaccgtcatctacgatccttgaagaaccagttgcagcgggagaaagagttgcttttggaatctcaaagacagttgataaaggaaaagacccgtgcggaagaggctagcttgatgaaaagcgctttcctggcgaatatgagccacgaggtccggactccgttaaatgctatcgtggggttctccggtttattggtggaaccttctaccgatgaggaggagcggaaggaatattcgtctatcatccggaacaacacggatctgatgttgaatctggtaaacgacgtattggacttatcccggatggagaccggagaccttcattttgacatcaaggatcatctgcttttagtatgttgccaaatggctttggagagtgtacgccaccggataccggatggggttaaattgactttttctcccgccggggaaccaatcgtggtacatgtagataatctgcgcctgcaacaactgttgacaaacgccgctaaatttacggagaaaggcgagattaatctatcgtttcaacttgagccggaccggaagaaggtacgtatagccgttacggatacgggcgccggaatcccccttgaaaaacaggctaccatattcaaccgctttgagaagctggacgattacaagcccggcgtgggtttggggctctctatctgtctcctgatcgccgagcggctggacggcgccttgtttatcgactcttcgtatacagacggggctcgcttcgtgcttatcctttcttgtgaaatagattcctcaatttataatccgccaatagaagtatgagcgtgatggcccctatgtataaatagaaagccaaggccgatgtgcttatcgtggggatggctatcttgggtatctccatatatacgaaagatacgatcgcgagggaaatcatgataagcgaggccacgatcgccgctaacaggctgaaccgttcgtcacgtttcttcgcctttgcggactcaagcatgatttgtcgcattacgttcgaacggaacgaggcgggaagctcctcctccggtatgcgtttgaataaatcccccaataaatcgggttgttccttatttgtgtttatcttactcatgatccattccatttaataatacaaacaatttttttcggatgcgatgtagcttgactttaatattcgaggcggtcaagccggtgatagagaccagttcttctattgttttttctttccaataaaagagcaagatcaaggcccgttcgtccggtagaagttgttcaagggcgacttccaatctttgaacctgttccgtggattcggtttgtccgaacaggttcgtaatttcctcctccgatacgttttcaagtgtagtctcctcaatcgctagaaactcatatctcttcttccggaccgacgagatcgccgtgttgtaagcgatccggtaaatccatgtggagaaactgcaatcccctttgaatgaggcgaggtttttgaataccttcataaacgtatcttgcgccaactcctcagcctcctcttggttttgtaccactttgaggatcaacgagttaatcggacggctatacttgtccaaaaggcaaacgaaacatgccacgtcccccgcttgtatcctttgtatgtaatatgtatcggtatacaattccattgtacttaatggacgcaagccgggtaaataggttacaacttgcggtaacaaaaataaaaaatatttttcagcccggaggtgtaacctatgggaaactgttgcgtcaaattagcaaacaatatgaatgaatcaattaaaattatacagttatgatggattttatttctgttccgctagttgtcggaatcgtttgtgcaggtatttacggattatttgagttgtttgttcgcaagagggaacgtttggcgattatcgagaagatcggtgataaactggatgcctctgctttcgatggtaaattgggactgcctcactacatgcgaaacttctcgttcagtagcttaaaggccgggtgccttttggtgggaatcggattaggtttgttggtaggctttattattaatatgtgtatggcgacaaattcttattatgatgatggttggtacaggcatgaggtagcgggtacggcttatggggcttcggttcttttgttcgggggaatcggcttgataatagcgttcgtcattgagctgaaactaggtaagaataataaatagccataggcttgcctgtatagacgtagcgtgctgcatgcagcacgctacgtctatactacaggtagatctccccgaagaattcaggacaatggaaattaggctcgggaaggtcgatcggactccaacttacgaaatgcggattcattgtctcatcggcgcatttatagaagttccctagtattttctccggcagattactaggatctaaccccatcaacttgagtggtatgactacgattaagttccatgtatgaatacctttaatctcctcgaatgcccttcttctcacggatgggagtcttatgatgcttttatactcttcttgcgaaagcgacgtcttgatatcccgtgaggtacggcgggcggcatcgcaagtcccgatacaattaaactcgaaattcatataatgcgagtcaccttcctttttcatgaagaattccacgcaactatccttatggaccgaggaattgtccatctcataagacgcctttagcgaattaccctgcacgctatatcgtatatatagatttttctctgtccgggctatattaaaagcggtgatcggcttatatggatactcatgccaattggcatgggtgaggaactcacgttgggattgcacctcaagaatcggttctatggatgttatatcgagtacatccagaacagggataacaggaactttcagtcttttcattttaactatagatttgaagtaaaggccattgtaagtaggaggtcaataaaaccgatagggcaccgataatagacaatacgataatgacagagcccacgatccggttcagtaaccaaatacctctaacgttgaaccattttctcagttttccaataatatatgttatgccgaaccaccaaagaacggcccctaaccctatgcaaacaatgcccaataccagcagccaaaacgaatgttcaggcagcacgaaaccaaaccgggcgaataatcctatatagagcaagacgattaacacgttgctaaaggtaagtagaaaagctgtaataaagtcttgggtgaacgataattttttttctcggtgtttctttaggttcctagtcgggttgctttggaagatataatacccgaaaatgccgagaacgatacttccgatcaattgcaggggcgcttggttcgcctccacgaagttgaccacaactcccatgcccagacaagtcagtgccgcataaatcacgtcggatagagcggcccctaatccggtgacgaacccgtgccaacgtcctttatttagtgttctttgtatacagagcataccgatggggcccatgggggccgaaaccaatacacctataatgattcctttactaacgattcctagcattaagttgagtctcttctagtttcttgggcaaagatacatccattccgcgataaaaaaaaggtaaaaaacgtaagatactgtagggacgaggctcgctcgtcccttatttcgggaaattgggactgtacaatagggtcgtatcgagagtcatcaatttaccgtctttcacgaatgaatctcctcgctcggacagatgctctaccatcatcttgcgtagttcggacaacttattctgataggctgcgtcctcactaaggttatgtgtctctcccgggtcttcccgtaaatcgaacaactgctcgcttccgttgtggaaattccagatatacttaatcttcccatcggtaagggctgcccagtaattatcgtcgctatagcaagtggcatgctccatgtctatataggggcgccattgttcctgctggccttggatcagcttgagtaaagaccgcccgtccatatcgggaggaaccgacccgccggcgatatcgataaaggtaggcaagaagtctctcagttctacaggttgttctatgctgcttccgtccggtatggatttggatataccggcgggccattttacgatataaggaatatgggccgaaccctcgtacggataggttttccgccaatgataatgatcgcccaacatatcaccatgatccgccgtgaaacaaatcagggcattgtcgtacatacctttgtcttttagggtctggatgatttgccctacttgatcgtcgataaaggtgatattggcgtaataatggcgacgggagtttatggcatacgcatccccgaaattaccgaatggggcatccgatgctccttggagaggatctttcggctcggcgtattgtccgcaccaatctcctatatggggtttcgggatatctgcgtccttatacatatccagataacgttgaggcggatcataaggactatgcgggcgggcgaatgataccttgaggaataagggcttgtcgttgtcgtagttccggatcaactcgcaagcggtctgtccggtccaagccgtaggatgaagccgttcgtctaacttatagacaccggcggcatggtcgttccagccgatacccgtaagatccgggtctttgccgggtgcctgcaattgaaaccattcccggtaatcgctgatgaaatcgggactttccacccggccactctcgtcgatcaaggtcgcgtggaatccgtgaagtgctttctgcggaaaccaatgcatcttaccgatcccgaaggtataataccccagattccgcatcatctgaggcatctcgtaacgatacttcaaggccatgcgtccgtatcccagcataccatgatgccaaggagacatcccggtcaataaaccggcccgtcccggagtactacttggagcggaggaatatccgctcacgaacaacgagccttcttgcgccagccggtcgatattcggtgagatcaccgccttgtttcccatgcagccgagggcgtcgccccgttgttgatcggtcatgatcaagatgatatgcggcttaccgctctttacgggcatggcgggagagacggcggtctctgcctctttcccgcttttgctatgcgtcatccccggaagtgtcgcacccagaccgattccgagggatgatttaatgaagtttcttctttccattatttagccttgatagtgtgatcccgaactccttttaagattccctgcaattggaaaacgatctccggatgttgcaaggccttgtttccttcctcgtagaccttcgtcatgtcgtataactgaggctcgggggaatatccggtctcaatcttctcatattccatgatagcggaacctacgctcggctcgatatatttccaatctttcgtacggacggagagtgccttattaagcgcttgctcgattacccacgggcggtcttccttgcttttcccgatccaagtatccagataatcatagctatccggcgcgcttccttccggaagacgggaattcgtcagtgaggcaagggaggcgaaccagtcgatctggctcactagcgcatctgatacggcggcttgcttgatctcctttggccaatgtacgatagccgggatacgggttcccccttcgaaggcactgtatttattacctctaagcggtccggcgggtttatgatcgcctaatagctccacggcccggtccgcgtaaccatcgtctacgacaggtccgttgtcgcttgacaagatgatcaaggtgttttccgtcaatcccatctcatccaatgttttcatcaattggcctacgctccagtcgaattgctcgatagcgtcgcccctcacgcccatcgggttctttccccggaaacggtcgtgcgggaagcggggtacatgcacgtcgttcgtggcgaaatacatgaagaaaggcttctctttattctccttgataaaatcgatggcgtgtgtcacgatagaatcggcgatattctcgtctttccaaagcgccttgccgccacctttcatgtaaccgatacggctgattccgtttacgatggattggtcgtgcccgaaactaggcttctggttgtataataattccggattatcttttccggtcggctctccgggaaagttcttctggtaactgacatagatcggggtgtccggatcgtagttcgccacctgcccgttctcgatgaatacgcaggggacgcggtctgccgtcgccgccatgatataggaataatcaaatcccagatcgccaagggcggtggggagtggggcgttccagtcttgctctcccgctttgtctcctaggccaagatgccatttgccgatagcggccgtggcgtatcccgcgttcttgaacatatcggctatcgtataacgctccggtcgtatgatcattccggcgtttcccgcggcgatgtccgttcccgggcggcgccatgcgtactctccggttagcatggaatatcgggagggcgtactggtagaagcggtcgcgtgagcattggtgaagcggatgccgttcttggcgagtcggttgatattcggggttttcacttgcgtgccgtcgtagcattccaagtctccatatcccaagtcatccgcgtagatgaacaatacgtttggcgttctaggtgtaatgtcttgtctctgttgggcttttgcgataccggctgtaagaagcgaggcaccgatccctacgataagtgttgatttcatgttgtttattatttagatgttctataaagagtttgtattatgactctatttcgttatcaaaatcaagaaggttatctgtctggtatttatcaaaatcggattggaatagacggtcttgaatgatacggtatttctcaaatcttttcttatcaacgacatagccgcgaatggcaaacttgtaatatttagttgcgtagcttttgccatcggaagcagttcgtcggaatttccgacagactgagtcttcttgtaattcttggctttgaaatatattttgtagatgttccgtgatagtggaacggcttttatcgaacaatacggcaatagcatcctgcgtcagccaaaggctttcgtcttgatataagacttctataccttcttctttattttctatttggaaaatcaagaattcagccgtgctgttgtgtatctgcaatttcttattcatggcatgttctatggacattaattatatacaaaaataaccaaattatttcagaatcagggtaactacaccaaaatatctatgagatggagcttaggaagaaatgctttttggctctggttaaaaggggggcttatcgtatattttcatgtacgctcttgctccttatcgaatgatgctgtaaaaagtcgtacgtgtttcccgaaaaacatgtacgactttttacagaaacacgtacgtgtttttcaaaaatcacaatcgtgtttttaaggtgttgatattaaacaatttatatatttgtgccatttgtataccttattgtatattattattaccaagacggaacacgcactgcctatacaagagtgggtaatattgatattgaagggtatgcacatgacatgggattcacttcctacccaagtggatgccagcaaacattcttgtaaatgaagaaaagttcggagagtgagttcggagacactgcggataagcctaaaaatataggtagaacagcacagaagatcatcgaccttgtcatttccgacctttctatgtcagccgaagctatggcttataaaattaggtataagttcccgtgctgtagaaaaacaaatcgcaaaattgcgttctatgggtatattgtctcgtgaaggcgcagactttggtggttattggcgtattattttaagttaccattttgaggggatgagacgcagcacgctgcgtctctacaactggagacaaaattgggcgaaaaaagtaagttagcttgctttggaagtgaggtattggagtttgaaaatcaaataaaatattatacatttgcatgactggataagtcaaagcgaataattggtatcaaacaatgataaactaaaaaacatatggattatcttaggttgaaatattattaatacgtatatttgcgacaagaaaaggctttttaattaagagcctcgtgttgcgtgtgatatttgtgctgtaggacgaaaatcggctaattttcttaaatctccctatgcacgaagaaggccccgcaaccctttactggatatacgtgttatctatgctaatatagtatggatatattttgtatacagataaagggggcgtgtggctgactttattgggagttgggtcttagccgaaccttcgtctacataaatgttcagtcctcgcccttcctttattttataagaaaggaccactacttaacaaaagccatatagcgctcgtctttacgaaggacatcttttctaaaacatgtccggatcttgtaaatctaataattaatcatgtaaagtgaatggcttatggacgcttgtaatattgatgagatccagaatctctttatttactactccgcttgtttcagcaagtattttccagagttagggttttattgtaatgagagggaattccagatacatggtatcgtgcggagatatagtgacattacgggagtgtcccatgatggctcttatttcttaattgagatgcgaaaagaatacctgatctacttaccgttattggtcggttccaaattccgcattttaactaaacaaaaacaactttattcgtaatacaatcttatgcttatgccagaactcatatccatagaagaagccgcccgtattaccggtttcccgtacgaggagattgaagattgggtaaaatcccgaaagataacctctttccatacgagaaccggtacacgtatggtagatcctgagaacctacgtgatttcattgcccatatcgaacatctagggattcaaaaactatacttgcaactggtcattcaagacaaggaggaggaagccgacgagattatcgcccagtacgacgattaccttttctgcctacgatccttaaagaacatctctcccctacttaaacaaatcatcgccgaactatccacatttatagatgataagcaagatcggtatatattcacggaaataacctctggggcaaaaatactggacgtagccaaacgctgcgatatatcttacgataggatgtgctaccgatataagaacatagtactccgcttgcaggaaaacaccggattcttagccgaatataagaaaacgatcagctgtcaagacctagagatagagcgcctgcggcttgagaagcgaaacatggaatatgagctgagaacgctctataaagcagtcctcaaaagtggcttgagtctcgatgctccgaaatcgtcgttcgacatccccacggatgcggccagacggatctccctaccggtcacaagcctaaccctgtctccctacatccgtaaatgcctccaaaaattggagctggaaactatggaggacctattgcgctacgctaggaagaaagggctcgattctttgttgaagatcccgggattcggccctctcggtttagaccagttaaaatttcagctggaaaagcataagatcatgaataaggccggagactcggatctctatcaatacatcatcaatgaaccggatagctgaacacaaaaagagcctctcttcacagggaggccctttttatgtgatgccggaaataaccaataaaaacttcccgacactacggtgttaatcatcttatatgcttacataaaattagcagaaggctttggtttgcgatatactaatagtgttacattctttttgacattgcaaagatacgtcggcctataagggtgcgcaatacctatatatatgtaaaaaaggagagctcatacctattaattgttatatatcttttcatggagatcgatttttagaactaatgatcttctcgcttgtaataactaacgcttacctctgaaataatacaaaaccgtattttccaaaattaactatcaagttgtcttgcgggtcaataatggggcctattgggtgtgacgtcctgaaaatattcttccgggatacctatgagtaggtaattagggtctcattttacctacttcgggcgattgtagcaaattctcagcccctgtaattttgccaaaaattataaaacgcaatgagaacgttaacaaatttattagcgattggattactttcctttaccgctctacatgctcaagagagtaatatgagctctaccgtaaaggcatcggagatgtatgccgacggtttttctaaattccgttttggaggatatggtgagatggctgccagttatatggattatgactggaattgggtgacacctcaaggtacatcacatatgaatcgggctactgtctctatccctcgttttattttagcttttgattataagttctctcccaaatgggtactgagttccgagattgagtttgagtatggaggaacaggcgccgcacgggaagtggagtggtacgaggagaatggagaatatgagaccgagatcgagaaaggtggcgaggtcgccttggagcagttccatatctcttatctgatgaacaagcatttaaacttccgttttggacatatgatcgtaccggtaggcttgaccaacgcacatcatgaacccttgaacttttttggtgtatatcgtccggaaggagagactaccatattaccttctacttggcatgagacgggtgtggctctatttggtgatttaggaaatttcgattacgagttacaagtcgtttccggtctggacccacaaggtttccgtatggagaactgggttggcaaaggtacgcaaggcgctttcgaggaaactcaatttacgcatcctgcctttgtggctcgtgtcaactataatggagtgaagaaatttaaaggcttacgtgtgggcgcttctttttattataaccaaccctctaagaatagtagcaaaccgctgcgtaaccaaggtgagaaatatccgcttaccatcgtgacggcggacgctcaatataaaagtccgaacaataatttgatcgccagaggtaatatcgtttacggccatctgggcaacagcaacgctttgacgaaggtaaacaataactcatcttcagcttccggatatcctaattcaaccgtggcggagaccgctgtcagttatgcggctgaggttggctataatgtaggttccttctttagccggaaagcccctagaatttatcctttcgttcgctacgaatattataatccgatgcaatccgtagaaaaaggcagtaataaactggcggatagacgtcttcaaaagagcgtgattacggcaggccttaactattacgcgttgcctaatctggtcgtaaaggcggattatgcgcaccgtattgtaggtaagggtgattataatagccagaatatggtttctgtcggtatcgcttatatcggctggttcttatcaagataatagactattaacaaatatatatgtaagaatatgaaaaaagtacttttattacccatgatgttgatgggtgtggctttgagcttcacttcttgtggagacgacgatgatccgggtaaggaccccgatgttgtaacttatgactttaagaatcttcctgcggattcgggtacgaaaccaacagaagatcagatgagtgcggttgtcgctactttcgttgatgaggtagctttgcctacctataaagacatgttgacaaagatgactgcctataaaaatgcggtagacaagttcatcgcgtctggttctaagaatgatttagcggatgcctgcgacgcttggcgtgcggttcgtgtaccttgggaacaaagtgaggcattcttgttcggtgtggcggatttggcacagctcgacccgagcttggatagctggcctttggataagaacggtatagaggagattatagctacaggagaattcagcaagatttcaggagctgtagacgaagacgcggaagatggtcctcaaaatttacgtggattccatacggcggaaaagatgttattcttagacggcgagcctcgtgatctggaaacaagcccgttcgcaaagaatgaattggagtatttgaagttagtgtccgaacgtatgttatctgatactcaagacttatacaatggttggttgaaaggcttaggaacttcggatgttccttcttcttatgcggaggctatgaagaaacatgacggttctgcctattccattggtaatgtttatcaggcgattgagcttatgctgaatggaaataatggtatggccggaatctccaatgaagtaggttccgctaagataactgacccggtgaccgcatggaatggaagtaataaagacgctactgacccgaataaccccggtgtcttggctgtagagtcttggtatagctggaattccttggacgactataagaacaatatcgtaagtatcaagaacgcttatttcggcggtcgtgatttggatgaggaatccgcttccgagagtagcttgcatgcgttgactaaaatgattaatcctacgttggatagtttgatggtagttcaaattgataagacaatcgacgctatcaatgcgatcggctatcctttccgtaacaatctaggggatacggagcatatcaatacggctacagaagcttgcgctgatttaacgacaggtttgggcgttgttaagtctaagttcacgaactaatcggacaagccgatacgatgaaacgaagattacttctattattcgctttatccggtagtctgctgtgtagttgcgaatccgaggacttggaaaattggcaggttaagaaacccaatgggcaggtagcttccgagaaggagttgtccgcgggtatctcaaccattttctccaatgccccggatgcgtacgatacgcaggcaaactgggttacgggcgaattagagacgcgatttaatcgtggtgatggattgtacgacgatgctcgcggtgttgagaatgtggatggtggaggactagggccgctttatgccggatattcttgcggttcctgtcataaaagtaccgggcggacccgtccggctatagctgatggaggttccggccccggcttctcatccatgcttatttatatatcacgtaaaagtggcggctattttcaagattatggccgggtactacatgatcaagcgatatacggaacgaaaccggagggaagggttaagattactactacttcccaaaaatatacgtttcccgatggggaggaatatgagttggtcactcctcattatgagataaaagaatggtatgccgatagtatcccgatgtcggatttacggatttccgtacgtcaacccttacggcatgtcggaatggggcagatgatggcgctcgacttggatatgctaaagcagatcgccgctaaaagcaattatccggaatatggtattagtggacgtataaactatgtgacggaaaagggaaagaaacagatcggtatctctggtaataaggcgaatcatgccgacttaacggtggaattgggattctcttccgacctcggtgtaacgaacgatcgtttcccgcatgaggtaggagaaggacagggtaatatgatgggttttgccatgaccggggcgcaggtctctacggaagatatggaagatgtggatttatacctccagaccttgggggtacccgcccgtcggaatgtggatgatcctacggttcttcaaggagagcaacttttctatcaagcgaaatgtcatttatgccatgtgacttccttgaagacacgccctcgcggatctgtccttttgaataatacggaattgcctcaattaggtaatcaggtgatccatccttattcggactttttattgcatgatatgggtgttgagctaggggatgattatcccagtggcttggccaacggtaatgaatggaggactaccccgttatggggattgggattacaagaggtcgtaaacggccatacctattatttacatgatggccgtgcccggaacctgacggaggctattatgtggcatggtggggaaggagctgcgtcgcgtaccctattctctcgcatgacaaaagacgagcgggccgctctgattaaattcctacaaagtttataaataaataacgcatagaatcgaaatgaaaaaaatatataggacgttgcttgtggtgcttctatcagcaggtgttttctccgtgaaagctcaagatacaaagaaagagatggatgataaatatgtagagaacgatgtggtttcactagcgggaaagaagggcttttctttttctaccaaggccggtgattttttgtttaagccctatgcgttggtacaggcaagcgcttgctacaaccgatatgacgaccaagggctggaaagccattatgccaagagcgtagcgaactccggtttcgcgatccctaacgctattctcggttttacgggtaaggcttttggacgggttactttcaatttatcgctgaatgccgctaagagtggaggtgctttattgcaacaggcttggttcgacgtagcgatcaaggagtcgtttcgtatccgtgtcggtaagttcaagacaccgtttatgcattgctatttaagtactttgggggagacgttgtttccggtactgccttattccgcttcccaatccgtattgcttccttacgacgtgaattatgtcataccgaatatgtccacgggattcgacttgggtgtacaggtacatggtttgatccatgataaatggaattatcaagtcggtatttttaatggtacgggtatcgacgtgaatttggcgactaagacaaactgcgatgatcataaatggttgccttcgctgttatatgcgggtcgtctggcctttatgccgaagggggagatgccaacgtctcaaggctcaccggagaatctgaacgacgataagatgtctatcgccgtatctgcctcttataatgcggaggccgagttcttgaccagtagcgacacccgtgtgggcgttgagttcgcatggatcaagaaccgctggtatgtggctgccgaaggttactatatgaatatgcattttaccaagatcatgcaaaaaccggataagaatttctggggagcttacgctcaattgggctatttcatcactccgaaattgcagggtgctttgcgatatgatttctatgatcgtaacgctacggatgagggtggtttgttgaatatgcccgccgctggtttgaattattatttctttaataataatttgaagctacaggttatgtatcaatatctaggtcgtagcggtcatgctacgcagaatgaccgggatgaggacgctattggattggctcgtcactccgctacggctatgttgcagttcacgttctaatctttgggtatgaaacgatatagtcaatatataatgtatgccttattcctgttattcgggctgggttgtgatgagggtaagatttatccggatgagacggttgattccgggcgaaccgctaccgtgtcactttctttcactggcctgaaagcttggccgaaggagaatatgctctcgttatgtgcttttggcgaggataagtcgaaacctttgcaaacccagcgtatcagtaagccggcggaagacggcaaaagactaaaactccgattgaataatgtcactccggatacgaggagtatagaggtcgctgtgattagtaggggattgcggttggtttactcctattatacgtctccggtggatgattcggacgaaccgcttgatttgtctgtcggcgaattggatttagcgagcttcaaacgtatacaagcgcaggtgttcgacttgaattgcttgtcatgtcatggaggaggatcgggattggccggtcagctggatcttagggacgatgtggcttataaatctttagtgaacgtaaaggcgcccctttcggaagagggtaagaactacgtgaccccgggtaatataaacaatagtttcttgctggatatattggagaataatccggtacataaggatatgttcaatagttccgggaaacaggaggtccttgctttgatccaaggttggatcttaggaggggcattggataattgataagaaagaaaatgatgaattatacgaggaggatagatacggataaagcggtagaaatgcaaatctcttcattcacgggtaaaggtggaacaacggaatatcaggtgatggtatcgatcacggacccttgtttgtctttcgtggagcaattgcaaaaccttttgcgggtttatgtgactgtcgtgaaggaagagctatcgaatgacgctaccgccgttttccgccgttattttttaagtgacgcagctaatcagacggatagcgtgatggagtgggagtgcgagagcgccttttgcccgctctctatcgttcagcagccgcctttgaatggaacaaagatcgctatgtggacctatttgcaaacggggatgtcggtacaaacgtacgattccggtttactggaagcgtcgcataacggttataggcacctctgggggggaggtgccttcaataaggcggccaattcggaatatcagacccggcttttattgaatgactatgtgatgcaattgatggggcagcgttgtacgttggcctctcattgtgtccgtacttggttctttgtgcaaaacgtagacgtgaattacgccggtgtggtgaaagcccggaaagaagtttttatcacgcagaatcttacggagaagacgcattatattgctagcacgggtattgagggacgtcatgccgatccctcggtgttggtacagatggacagttatgcggtggatggattggagccgggacagattcagttcctttacgctcccacgcacttgaatcctacttatgaatatggagtaactttcgagcggggtacggctgttacgtatggggatcgtaaacaggtctttatctcgggtacggcgagtatcgataaccggggagagattgtctatccgggcgatatcgtaaaacaaaccgagcggatgatggaaaatatcagcgtgttgctgaaagaggcggacgctactactcgtgatattacgcaggcgatctcctatttgagagatatggctgattatgcggtggttaagaagtattttgaggcgcattacccggatttgccacatttgatagtcttggcccccgtttgccgtcccggatggttgatagagactgagtgtatagcggtcgtgccgacggagtcgtcctttaagcctttgtgaaataataataaatgtacgagatatggaagaaaaaggagtatatttggctattcaaacaccaagacaagttagaaagaagcctatgtataaaaatggaatgtaccgggaaaccgataaaatgagtgatctgatctgcgagaactatccgatggttttagtcatgagccgctttggtatagcgctcgggttcggagagaagaatatcggggaggtttgccggcagaatggggtggatgcttgtactttcctgacggtcgtgaatttcttggtcgaggaagtgaatacgcctgtcgagaatatcagcaaatgcctgtcgatcgagaacttgatccgctatttgcataatgcccatgattacttcttgaacttccgcttgccacatatccgtcgtaaattggtagacgctatatccgggtgcccggaggatgtcgcttttgtgatcacgaagtttttcgatgagtatgcggaggaggtaaataaacatatgtcttatgaggaacgtgctgttttcccttatgtccgtaatttgttggaaggaaagagagatccgaaatacaatattacgatcttccgtaagcgtcatgatcagatcgagatgaagatcacggagttgaaaaatatcctgatcaaatactatccgggagcgggtacgaatatgctgaatagtgtcttgttcgatatttttgccacggaggaagacttggcttcacatacccgtgtggaggattatttgtttgtaccggccatattggctttggaaaaacaattataagcatgaatcgatgagtacaaatctaaagattgcgatagccgaaccttctgttatcataaggagcggactggagaacctgttgaaacggttaccgggtttccgtatccagatggtggagattcattcggtggaatctcttttcgactcgcttcgtatgcacaaaccggatgtgttgatcgtgaatccggctttgcccggctatttcacgttgcaacatttgaaggaggaaagcggctgtgccgagatgaaatgtatcgctttattatattctgtctcagacagtgtgttattgcgttcttatgatgaacaaattaacatatacgatagccctgatgagatcaagcacaaattggaacggttgaacgccgaggtacttccggatgacgagccggaaggggatgacgagcaacaatcgttaagctcgagggaaaaagagatcgtagtctgcgtcgtgaagggaatgacaaaccgggagatagcggatcgtttgtttctttctacgcatacggtcatcacccaccgccgtaatatcgctcggaaacttcaaattcatagtgccagcggtcttacgatctatgcgattgtcaataagctggtcgaattaggcgacattaaacagtaatcgtatatttataagtaagttaaagggaatgtggataagcgataaaagcgccttccgcattccctttactattaatataattaaatttaatgatcatatcttattaacgcttatcgaaaactaaaacccgtttattcctgtttcttcttcaaatcattaagcttataagaaatgaagaaagcatttttacttggattagcattgttattttccttatctatgagcgcacagcatttcgcgttgaagaacaatcttctctacgacgcgactacgactccgaacttaggattcgaggtgggcttaagcaaaaaggttacattggatgtctcggcgggatataatcctttcaagttcaatgacggtaagaaactgaagcattggcttgtcatgccggaagtgcgttattggacttgcgagaaattcaacggtacgtttattggcgtgcatgcgttgggcggacagtataatatcgccgggattaaattaccctttggcatattccctaatttgaaggatcatcgttatgatggttatttgtacggtggcggacttacgttgggacatcaatggatactgaataagcgttggagtatagaagccgctatcggcgccggttatgcccgtgtacattatgataagtataattgcggggaatgtggctccaagatcgagaccaagaactcgaactattggggtgtaacgaaagcggccctttctatcatttattttatccactaaaaaacgatctagagagatatgagacatttattgagtatatgtatcgctttattgttcctcggaggtgtgagcctacaggcacagaacggtgtgcggggaactgttagtttcgagaatgtaagcgcaaggaaggacggaagccagcttatgatgaattttacgaccaatctgagtaatctgcgtttgaaatcccaagagatggtcatactgacaccggtattgcaatcggtggataaatcgcagtcttaccagtttaacccgatcgtgattaccgggcgggcacgtatgaaggcgttgaaccgtgagttgggtttcgatagttatgaatttccccaaactcctagcttgattatccgtcagacgaagaaggggccggaattgattccggtggaattgtccgtaccctatgcgggatggatgcgaaacgctaccttgatggtggatgagaataccacgggatgcgcttcttgtgaggtctcaaatgacatctatggggtgatgagccgtgtattgcctccgttagcccctcccgtttatgagcttagctatgttactcctccggtagaacctgtgaaacaacggagcgagacgcattccgcttatttaaactttgaggtaggcaagtccgtattgttacgtgatttcaaagataacgctaccgtgctgaatgaggtgaataagattgtaacggaagtccgtaacgataagaatctaagctttaccgaatttaaggttaccggatacgcttccccggaaggtggctacgattataatatgagattgtccgagagtcgtgccaaggcttttgtcgcttacatgaaagataaggagaagatggatccttccttgatgaaagtgaattggatgggtgaggattggatcggattgcgtcaagaggttacgaaatcagatttggcgaataagaaggagattctggagatcttggatattcaagatataaacaagcgcaaggctaaactacatgccttgaacggaggtcggacttataagatattattggataaatactatcctcctttaagacgtattgattataccttggcttatatcgcacgtccgttcgacgtgaacgaggccaagcaagtgatcaaaacgaaacctcaatatttaagtttgaatgagatgttcttggtagccaattcttatgataaaggtagcgatcagttcaaggaggtattcgatatcgccgttcgtctttatccgaccgacccgatcgctcaattaaatacggcggcccttgagattgagactggtgcttacgatccggccatcagtcgtttgcaaggtattaatttgccggaagcatggaataacctaggtgtcgcttatgcgatgaagaaggattatacgaccgctatgcaatatttcgatcaagctgcccaagccggcatgcaggatgccgccgcgaaccgggatgagctggccgcttggttggccgagcaataatggagatacttaccttcgaatataaaaaaagcccccgtttccggaggctttttttgtgcttataatttagctttccattcattcatcaactcggtaatggtttcccgtaccgaagtgatcttattcgctcgccaagcgttactgccggcgaaagcgtatccattctcgaaattccctttgaaggcgttgtacaaggcggtgacgatacaatacgggctgcgtgatatatcgcacgtcttgatacagttgaagggacaagctttcggttgcttgattcccgccttcactttctcaaggaaactgcaatggatggctcgtccgggcatgccgacgggacttttgatgatctctatgtccttctcctctgcctgtatataggtctgtttgaaggcttccgaggcatcgcattccgtggtggtaacgaaccgggttcctaactgaacgcctgatgctccaaggtctatcatgcgtttgatatcttcacccgtataaatgcctcctgccgcaattaccgggatctttttgtcgtatttctgctcgaaatgagagacttcctctacgacttgaggtaataattcttccaatgagaaatgctggtcttccaactggttttccttatatcccagatgtccacccgctttcgggccttctagtaccaccgcatccggaagataatcatagttattcttccatttctcgcagatgatgcgtacggcacgtgcgctggaaacgatgggaaccagcttggtgacgctatctttcttgaggaaagaaggcaagtccaaaggcagtccggcaccgctgaaaatgatgtctaccttttccgctatactggttttcaccaattcggcgaagtcggaaagagccaccattacgtttacgccgatgatacctttcgctttttcccgggccttgcggatctcttccgctaacccgagattcccagcttccgtataattgctgggtgacaatttcttatataaaagtccgagaccggctgcggagataacgccgatcccaccttcatttgcaacggccgaggctaagccggaaagagagatgcctacgcccattccaccttggatgattggaatacgagcctttaggtctccgattgttaatgtcttcattaaaaaaataaatatagtgtttcaataatcgaggcaaaggtagcacaatatcccaataaatgtgcgaaatggaccagaattatcgcgcaaatattctagtcatgtgcaatgtatggaacgaaccgattattttatgtaaattcgtccctgaataattaggcaagacgtctgtaacaggattgtaatgtatgtgaaacgggtgtgaaacaggagcgttgtaactttgcgacgcaaatatagtttttatagttaggaatgaaattaggaaaagttatagcgctcatgttagtgctgcttccattcagtatgggagcgcaggaggtggatcagtcggtggaaaaacgtatcgattccttggctacggaagtgactaccttggataaggtagtccagaagctaagcaaattcaaggtttccgcttatatccaaggacaataccaatatggacaggaggacgctaccttgaaagtgggcgataagaacgagaacttggataaagggtttaaccggatcggtatccgccgggggcgtatgaagtttgagtacaatgatgggatcggaacaggtgctgtccagatcgaggtgaatgataagggagtaagtttccgtgatctgtatatcggtatcaaggacccttggacgaagcgtagccagttgatggctggtgtgttcaaccgtcctttcggttatgaggtctgttattccacgagttctctcgaatctccggagagagcgactattatccagtatttcttcccggatgagcgtgacttgggagcgatgcttaccttacgtaccaagactaccagcccattgagtttcttgcgattggatgccggtctgtttgccggaaacagtattaaccgggagacggatagccggaaagatttcatcgggcgtctgggtgccgagaaggcgataggcgactggggaaaatggggagccggtttctcctattaccatggttttgtctacaacccgactaccgaggcgtatgagatgcgtggcaatcatttcgttaagagggatatgggagagacgggtacttatatgaagcgccagtatttaggtttggatggacagtttagttttctttcatctttaggaaagaccactctccgtgcggaaggtttaatcggtacccaacccggtatcgccgggagcagtaaaagcccgaactacagtacccgaccggagaatttgccggaaaattctttgttcaagcgtcctttccttggttacttcttttatttggtacaggatataggcgcctctcctttctccgccgtattgaaatatgacgtttacgatccgaatacgaaggtgagtggaaatgaggtaggggcggaaaatagcttcacctcaaaaaccgacttggctcaaagcacgataggtattggcggtatctataatttcaataaacatatccgtctacaagcttactacgagtttaacttcaatgagaaaagtaacctcgtgaagggctacgagaacgaccggaaggataatgtattgacagtccgtcttcaatataagttttaattcataggattgtaatatctgtttcatcccattgaaataccgaagtatttattttgtatcgtaaataaaagataaatacaaagtaatgaagaagacgattttattagctgccatggcagcgtgtttgtttgctacgaatgtgtttgcccagaagataaagggtagcgatacttgtttgcctcttacccagactgaagccgagaatttcatgaataagaacaaagccgctaagataacggtgacgggtggtggctccggcgtggggatctccgctttgatggaaggcactacggatatagcgatggcttcccgtaagatgaaattcgacgagcgcatgaagttgcaagaagccggaaagaaaacgaaagaggaggtgatcgcctacgacgctctggctgttgtcgtgcatccttccaacaaggtatccaatctgacccgggagcaattggaaggcatttttaccggcaagattaagaattggaaagaagtgggtggtgcggatatgaagatcgtggcctattcccgcgagacttcttccggaacctacgagttcttcaaggagagcgtgttgaaaaataagaactatatgaacggtatcttgagcatgccggctacaggtgccattatacaaagcgtaagccagacgaaaggagccattggctatgtaggtcttgcttatttgaataaagaagtgaagccgatccatgtatcgtatgatgccggaaaatcctacgtggagccttcgttggagaacgcgaggaataagacctatccggttgtccgtccgttgttctactactatgagacgaagaatgcctcaaaggtgcgaccgttcatcgattatgtgatgtctgccgaaggacaagcgacggtgaagaaggttggttatatcccggtaaagtaagcggagaatccggacagcgttgtatgagcacatcatacaacgctgtctaaggtgcttcgacagtactgtctaaggtgttaagacaacgctgtcttatgtgttgggataagattgtccgtccgtctcttccagaaactgatccatatacagattctcgccatcccatacgatataagagaagaattgcatccaatccccggctatgagaatacgggaggtacggcttaacatcaagtccaacatgatgtggcgatggccgaaaatgaagaagtttatatcgggatgcgtctttagatattccttggcgaaaacaaccatatattctgcgtcttccccttgatactttttagcctcttgcttttccagtccgctcttccggctgttgagcgaccagcctaaagcgaacccgaacgtccagcggggatgtattcccgcatataaccattggcagaacttgttccggaaaatagccctgatcagacggaatgccttactccggaaatctacctcatcgccatgcccgaggaagaaacgtttccccaataaatcgactgtcaaggtatcccgatggatgatggcgcctatctctttcggcaagtagtcgaacatccagatgtcatggttaccgataaagatatgtatttctatacctctgtccgctaactcggccaatttccccagaaaacgtacatggcctttcggcacgacgtatttgtattcgtaccaatagtcgaatagatctcccagaaaccaaatggcggaagcgtcttccttgatgctatccagccaacgtaccagtttcttctcgatggctaaagggtccttgtggaaacgggctcccagatgtgcgtctgaggcgaaatatattttcatagaaaacctaattccagtttagcctcctccgtcatcatgtccttgtcccattccggctcgaagacgaggtttacctctacattgttcaccccatcgaccgcttctaccttcatacggacatcttccaatatgaaatcggccgccggacagttcggggcggtgagggtcatatcgatgcgtacatttttttcctcatcgatatctaccttatatataagcccaagatcgtatacgtttacgggtatttccgggtcgtataccgtcttcagcatagcgacgatcgcttcttctgtttggagaaattcgttgttcatcttcttttgttttatacgcgaatatacattaatacttctatatactaaaccgggggaaaagagaatttgtttcaccggatcagccttccttcgtctgcatagctataatagccgctatcggacaggatgatatgatccagtatcctaatatccatcagcttcgccgccttttggatacgctcggtcaaggcatcgtcgtgcgtactggggcggaggctaccggatggatgattatggcataggattataccggaggccaagacgttgatcgccgcttttaataccaaacggatatccacggaagtctggtttactccgccctgactgatttttatcttttgtatcaccttatttaagggattggttagagcgatccagagttcctcataaggtaaatcgcatagttgggtacggaataggagataggagtctttgctgcttcggatagcatcttgaggagatgcctctgaggtttcccgccgtttccctagttccatagcggcgcagatcgtgaccgccttcgcctctccgatacctttaaagccggaagttaattctttgatggaacgtttacccaatgtattcagattgttgtttacggagtgaagtatccgttgagagagttgtacggccgtctcctcattgttgccggatccgatcagtatggcgatcaattcggcatcgcttaatacggaagcgcctttttgaagcattttctcacggggcctgtcttcttcggcccattccttgatggaaagttttcctgtcttttctttcatagtcgggaaaggtttatgatttggttaaaaaaatagttcccgcctgcttatcaagcgggaaccgtatattttgacaagacccggattactcgcggatacggcctacgtaagaaccatcagtcgtattgatctcgataacctcgccctcgttgatgaacaacggaacgcgaacttccgcaccagtctctacggttgccggtttcaaggtgttagtagcagtgtcacctttaatacccggttctgtataagtaacttttaattgaacttttgtaggcatgtcggcgaaaagaaccgtatcggtagatgcatcagaaacaacgtctacaatttctccctctttcatgaaatcaacgccgttgatcaagtttttgtcgatgatcacgtcatcgaatgtctcttggttcatgaaatgataatgctcgccttccgtataagtgaactgatacgggcgacgttctacgcgtacatcttccaacttctcaccgatattgaaacgacgctcgatctgaccgccttttacaacatctttcaatgtggtacgcatgatggtattacctttacccggttttacgtgaaggaaatcgacgcagaaatagagttttccgtccaaacggatacaagttcctttcttaatgtcttgtgaattgatcatatttattttctttatttataatgttatagagtaatccttaacgattttcgggggcaaaagtagtacattcctgctaaagtagcaaaaagttttgcgtatttatatggaaaaatagttgcaaatcaaccgaataaccggaaccaagaccgctgtcatgatacccatcaagccaattgccagtccgcttaatgctccttcgatggccccgatttgaatggccgctgctgttcctactccatgggaggaagcccctaacgccagtcctttagcgatatggctatctattcccagtaccctcatcacaatagggcccactatactgccaaagattcctaccgctacgacgatgacggcggtaagtgaaggtatgccgcccgctttctccgctatccccatagcgatcggggtggtgacggatttcggctggagcgtggcgatcaacgcttggtcggctcccatcaatttaccgatgatgattacgcttacgattccgacaatggccccgacaaatacggaagtcaagatcgaaacgacatttccctttagatattggatttgctcatataacacatagccaagggccactacggaaggccccagcataaaatggatcaaatgactgctttgctggaacgactcatattgaatgcctaggacttccagtaccacgataatcacgaagatggtcgtaagcaaaggatgcaaaagactgatatggactttcttgtaaagagccaaggaagtcaggtaggtaccaattaccaaggtaagagcgaaaatctcggaatgcgccagattatccatggtctattttcccttttccagtttttgttgcaccaacgctacgctggcgatgactaaaattgtacttactacggaagcgatcagcaggactgcccaatactcggagatgatcccgaaggaattcataagccctacaccggcaggaacgaagaataatcccatgttttgggtaagaaccgtggaaagacgtttcaccttttcaggttttactttcttgaacgcgagggctaaaaacaatagcaccatcccaattacgctacccggtatgaaaccgtcgataaagtagctgataaactctcccgtgaaatagaagaagagaatgtaaaatgcttctgttagcatagtttttctaccttttttgataaccgctacaaagataacagctatttcgtagatatgttctataacatattattttaacattgtagggacggcgtccgtccccccgtggtatcaagctaacgcggaagtaatgaacatataaatcatcataccgataatatcgttggtaatggtgataaacggcccggtcgccaaggccggatctatcttcatcttatctaaggtcatgggaactaacgtgccgaatatactggcgaacattacgacggcgaataggcttaaagatacggaggccgtaatcccccggtctcccagcatgaagaagttgtaaatgaacacgaccagactgataatgctggcattgattaacgaaactacggactcttttaggatttgcggtacgatattcccttccttcaaggtattgtttgccaagccttgtaccacgatagcggaagattgtatgcctacgtttccaccggtaccaccgatcagcgggataaatagcgccatcttcgggttagtggcgaaactgctctcgaaaccaccgaggataacggagtttcccaatcctccgatcatgccgatcagcagccaaggtaggcgggcggcggtttgggtgaatacattatccgaggtttccacgtcttgcgagataccggatgccaactggtaatcacgctcgtgttgctcgcgtacctcatccataacgtcatcgatcgtgatacgtcctaccagacgtccgatactatcgactacgggcaaggctaccaagtcgtatttctcgatcgtctccgtaacctcctcgatactgtcgctgtcgcgaacggagatcgggtcttttttcatgacatgcttgatcttggagacggatgggtgggtaatcagtttctgcaaggggagcacgcctttcaagcgctcgtcgtcgtccactacatatacataatagatctcgctcatctcctccgcttgcttgcgcatctcgtcgatacatttgggcatactccaattctcgttcaccacgatcatctcggtacccatcaaaccgccggcggtgtcctcgtcgtatttcaacaagtccacgatatcaccggcctgttctacgtcctcgatatgcgaaaggatctcctcttgggtatcctcgtccaactcacgcatcaagtcaacggcatcatccgtttccatgttatcgacgaaacgcttggcgataagctcattgggaagttccttcaataacttatgacggtcttcctcatccaactccatcaatacatccgccgctttgtcgccatccatcaatagatagagataaatggcctcttgcaagttcagttcttgataaagctcggctatatcggcaggatacagttcatgaagtacctcctgtgccttcgcgtcatctttggcctcgatgatgcttttcaggttctcgatgtaatctttcgtcagttcgatcattggactcttatattattataggacatcaccagcctgcttctccagatgcttttggctgatcaaggtcagttccacgaattgctccacggataactgttccgggcgcttgtcgaatatcggcaaggcgtaatccgggcaatctttacccaataggggtttcatggaattacgaagcgtttttcttcgttggttgaatgaggtctttactacggtcttgaataacttctcgtcgcatcccagctccttgcggtcgttacgagtcattttcaatacggcgcttttcacctttggaggcggatcgaatactttctcactgacagtaaagaggtattccacgtcgtaccaagcttgaagcaatacgctcaagattccgtacgtcttgctaccgggacctgccgctaggcgttccgctacctctttttgtaacatccccgagcagcagggaatctggtccttataatcgaggactttgaagaatatctggctggagatattatagggataattaccgatcacacaaaactgccccggaaatagcttcgagagatccaatttcaggaaatcctcggcgatgatacgtcctttcagatcggggaaattctggttcaggtaatctacggattccatgtccaactcgacaacggtcaaatcatgtcccgcctccagcaagaactgggtaaggactcccattcccggtccgatttccaagaccggcaaggatttgaaagtatcgagtgtgtccgcaatgcgctgtgctatttgcagatcctttaggaaatgttgccctaatgctttttttggcttaactaatctcatccacttttcggtgtaatgtgtttgtttttaaatattatgcttatctttgcggatgcacaaaagtacaataaataatttaaagttccctatacctaatggattttaagagcattctacgtacgtttctgaagataattctacctttagccttcggctgtttactcctttggtttttgtatcggaaaatggatatcactgagatttggcgagtagtcaaggagggggttcgttatgatattattctggtttctttactgttcggcttgttcgccaatatcgtccgtggtttacggtggggattgctgatcagttccttgggcgagcgcttcaagatgagtaacgtgatttacgccgtgctgggtaattacgcagtgaatctggtgttgccccgtgtcggcgaggtatggcgttgcggcatgatcacgaaatacgataagatctcgtttaccaagctgttaggtacgctgttgatcgaccgtgtgagcgatacgatcatggtcggtttgataaccttgatgatattcatatttaatataagcttctttacgagtttcttcgctaagaacccggctttgctcgaagggttccaatccatgtttaattcgatatggatttacgtggcggtgataatttttgtcgctgtaatttggtttgtattcacttatatgagtaactttacgctggtacagaaagccaaaggcatgttgaagaatgtatggaccggtatgaagagtatctggtacatggagcataagatgcgtttcgtgatagagacgttattgatttggggaggttatttttgttacttttatattacgttctatgctttcgactttaccaaggacttgggtatcgtggtcgggctgatcacgtttacgatgagtagtatcggcgtggcggtgcctgttcaaggtggtatcggaccatggcatttcatggtgatcgctaccttggtttgttttggcgtgaacgagaatgacgcggcggcgttcgccttggtcgttcatacggtacagacggtatggacgggattgtgcggattattcggagtggtagctttaccgctcaccaatcgggagaacaaggaggctccggtcgctgtttcgtgatgaatacaagatatgtattaaatatgaactgaactaaattattaacatctatgtcagcagaaatcaaagatctatctccgaagcatgtatggggttatttttatgaccttacgcaaatcccccgtccgaccggacatatggaggcagtaacccgttttatgatatcctttggtaaaggattgggattggaaaccctgcaagatgaggtgggtaacgtattgatccgtaagccggctacgcccggaatggaaggtcgtaagaccgtgacattgcagtctcatctggatatggttccccaaaaaaactcttccgtaaagcatgatttcgagaaagatccgatcgacgcttacatagacggtgattgggtgacggcccgtgagacgactttgggggcggacaatggcatgggcgccgctctggcgatggccgtgttggcggacaatagcttgcgtcacggacctatcgaggccctgtttacgattgatgaggaacagggaatggacggcgctttcggcttgaagccgcatttcttaaagggtgatattttattgaattgtgattccgagaaggaaggggagttgttcgtaggttgcgcgggtggcgctaacgtgaatgtctctttccaatttaaggaggatacttatattccggaaggtgacgtggctgtcaaggttagcttggctggcttgaaaggtggtcattccggtgtggatattcatttagggcgtgcgaatgcgaataagttgatcttccgtttcttgaaagaggcggtatgcgattatggcgctcgtttgtcttctgtggcgggtggttccttgcctaacgcaatccctcgtgaggcttttgccgtgataacgattccgggtgataacgtggagtctctttgggagctagtggctgattaccaagatatgttccgtacggagtatatgggtgtggaggataagatcgatttcgttgcggagatggttgaattgccgtctacgttgattccggaggagatacaggatgatttgatcaatgcgatcgagggttgccagaatggtgtgattagcatgttgcatgatttcccgggtacggttgagtcttcctctaacttggcgatcgtgaagacatctgatgagttgatcgaggtgaaaatcttggtgcgtagctcatccgagtctcgcagggattctgtttgctcaagtctggaaagtgtattcgctttggcaggggctaaggtggaggagtccggtcattataatggctggcagcctaatatcaattccccgatcttgaacttgatgaaatctacctatctggatttatttggtaaggaacctgaggtgaaggtgatgcatgccggattggaatgcggtatcatccaaggcgcttatccggatatggatatggtttctatcggaccggatttggaatatccgcactcaccggatgagcgagtgaatattcattccgtacagaagatctgggagtttattacagctacattggagagaatctaaggaactctttccttatagatagtagacaagccctccagcctttgttcttctaaccattcggttagcgagaatagggctggagggcttattttataatttctctatatcctcaagggagagtccggtgcatttttggatgatgagaggtgcgattccctcggctttcatgttacgggccgtagattctttccctttcaatatccctttctcctccgcgtaatcgatcgtattcttataatccctgtatcgtttcagagcctcgtcgtattgtatgcgctcctctttgctgaggtttgccacgtcggctacttccagcaacttgtcgaagaccgcctttctcgccttgaacggcattctctctaaagtgtccatatgcttcaataaataaatccaacgttcaaaatcgttctcgcactcgtccggttctttttggaagtagggcagctcgaggtagacttgccgtatcctgtcgctgaacatccttccggtttccctgtccgccaatataacatcggtccggaactttgagttcacgtccatcttgtagttaagtaggaataccccgtatacgggttgcaacgcgaatttccagtccttccctctttgcccttggttactgatggccctcgccagatagtacagtcccctgtcgtggaaatagggttgtgccccggtttgcatctcaacgacgaataggtttccgttgctatccttgcaatgcacgtcaaaaacgattcccctgtcatccagcgtctcgggggtctgaatcgggttaaggaacgtgatatcctcaatgtcgtgctctccgaagaacaactggttcaggaaatcgattagtaactccttgtgtacctcctgcccgaatatccggtgaaagccgaaatcggtgaagggattgataaattttcccatagtgtttataggttttagtgattaatatgaaagggatggttctttttccatctcttgcggtaaagatacgctttttatttttaacacgtacgtctttttgaaaaaacatgtacgtgtttccggaaaaagacgtacgtgttttttgaaggtcataatgttgccgtaatatctaggatcttgaaggaatctcatgtcgtgaaaacggttgttatcttgactttttgtttgatataaggcttaaatcgtggcaatccctttttgccggtattgtgaaatagggggaagggggagacgataatcggggttttatataaaaaagtacggccttttacgcacgatatacgacaaaagcctgcacatatagtcgcgttgggtaacgcctatactgccgttgggcattataaacagtcacgaatagggttggcggtagtcgtgaatgggtattgtaaccctgttagaacccagtcgtaaccctatgggatagcccgaagaagtcaatagatatgaattacgatgaatgaatttcgctagaacggaaggcggttttttagcatctgcctgttaattagttgattgctatttttttcttacttatttgggaacgagctgtacctttgttcgaaaaaatcgattctccgggagttaagaatacaaaatgtcaacgtgttacttttggatagatatataaatgtacgtatgtacattattataaaggcgtaaagtttgtatgattcataaatactattatcgtgtagaaacgactagtttaaacgatcgattcttttagtcatttgcaaaggtacgcgtttcttcgacttctgcaacccttccgggctatttttttcaccccttatcctctttcttatcaatcaaataggctatccgttacgaaataaccgattccgtaaacgaacctctcttttcctccctcaaaaaacgactaatctagacgatcgtttagactagtcgtttttatgtggtttggggatcggtttaatagagctaagtatttgattatcttaataaacactagtattaatattaatttcagtattatgaacaaaaagttttctactttggctgctgtcttcttggcagtaagtgcgctttccacaagtgcggtagcgaatgtgacgaacggtaattattatcgtttgaaatatagcacgactaccccaacttcaaccgaaaaatatttgggtgtggatatagcgaagacggatagtgtcgtgctgaattccaaggcgactggctcaacagtctctgcgggaacggatactccggataatttgttgagtgatcgttatttctggaaagtcaacaagactattgcggctagcggtgattcattgtttacatttacgaacagaaaaacaggaaaggtattggctttcgacgctaaggaagcgaatgctatcatttctggtggtgccgtaaatacttggggatggaaggggcattcttcttcggcttctggaatttattccgtatctgggggtaatacttattatctcgtagaggagagtggcgttgtaaaagtaaagaaacagacaggagttacccctcccacaagtggtatgcttgcgctagaggaagacgtacctgcggcagcgaatatgtctgccaagcagttgaatgagaaaaatggaggtaaaggttttgagctagcgttctctccggctgcaaatggtgagaaaaatctcttcatagaatctatgttaagagcggaagctttacatgatggaagtacgactggtactttcgaattagattctgatgcggatcatgctcctgttgtaagttctcctgcggttttagctggtgacacagctttcttcgctgttagtggcaaggttattgagaatgcggcaaaacaaaaggtacaatattacttggtggctgatactacttattttacaggattgggtacgacaggtgttgtgtttactcaagatacgttgaaaataacgaaagatgccgccggaaagattactaaagtggagcccgctccaggacgtgtacttaacgcttatcgctttgtgacctcgtataattatgataaagcctccatgaatattgaggtggttggtttacaggcaaagaagacaagcggatattacaaggatgatgtgcaagagaaatctcttgcatctggtaagtcttggtatgtatatgtggcagaattgtctgatcggaaagaggtttctgttatagaaaatgcgacagctccttctacaaagatcacgtttaagactggctccgcaatctctgatctgaatacgaaagtagcttacgccgtccagaaagtgaaggatgatggttctttgagtaagtattatggtgctaataatgcatctactaataaggatagcctggatgtcgcttctgccttagttcctgctacacagtatatcatgattcatgaaggtgagaacaactattctttgtataacagagcgtatggtaataagcttgaggaggcttctggcgcttactataagaccgataaagaaggtatctatcgtatcaatggtacggattataagttgacagctcttactaccgcagctggtgaagccggcaagtatgttggttatagacatttctctgattcagaggtagcgaacacatcgtttactttgcgtgttcaatctatcgctggcaatagcatcttcattgcatccaaggattcctctattttcgccgctaatagcgatggacagttctttacggtgaaaccttatgactctgagaagtttggttatacatcgaaagattccttgagccgcacggcttatatgttggttgaacgctatggtgacagacatctggcctatgataaagcgaataagtttgtcttgtctaaagaggcttataatacgcagaatgacacggtggtcgtattcttccaggctaccgccactgaaggtcagtatttgttggcttatgctcaaacagatgagacaaagggtaagttggcatccacttctatggacggtaactatattatcgcgaacattactacgggtgctatcgagaaatctgcttctacagcggtagctcctaccgtattcgtattcgagaatgagaagaatgagtaccaagcagaggcggcaggtcataagatcattactttggcttccgatgacgctatgtctatcactcgtacggatgacaatttcgcttccttgaaacgtgtcggtcaattgagatccgctttcgaggccgagaacttcgctttgtgggttgataccgcagatgctacggacgagacgaaaccattgtattttatctctactaagcagggtttggattctgctacggtaaaggccggcaatagcttgtatatggtaagcgtagaggattctacggctaacgcttataagtgggaaggtctttctcgcgtagcgtttatcgagggtaagtatgtggcaggcactgattccttggaattatataccgctacggatacggctaaatatgtgaagaagcatgataacgaggctaattgggcattcgctttgaacccggatggtggcgtgtctttgcagaacatgaagtcaaatcaatatgtagctactcgtaacgacgtattggtgatggttaagaagatggatgaagccgccatgtttggtgttgctaaatctgaggtaatcccgacctcaaatggcactatcgacgctgttgagggtgtgtctgtgacaactgataacggtaccgtaactatccaaggtgccgcaggtaaatcagtagttatctctaacatcttaggtaaggtagtcgctgagacagttcttacatctgataacgtaactatcgccgtacctgccggtatcgtagccgtagcagttgaaggtgagaccgctgttaaggtggtagttaaataataaagatatataattctaagattcccgtgcggagattcgtcttcaagtaaaccgtgaggtagaacatgcggggatattaatactaaagtaaaaaattaaagctctccgtcagtatttccgtgaggcaagaaagcggaaaaagaataagccccggtcggtttctcgatcggggctttttgtctattctttgtcgtttttatctttaagtctcaatccggttctagcgttgaggggagagattaccgagtggcctaaatcgctttcaagttgtttgcgggcggcctctgctgcttttcctccttgtttggcgataacttcgtgttcttcgagatgttgcggattcttttctttggcagttttaccggcccacgtttgatagatgatatctgtaagggtagcaaactgaacgccctcttgtagtccgtgtcgtttccattcatcggttaggtctttacgtatctcgatgcttttaaggcgttgattaatccaattatccgagtaccccaacgctttatattccctcatggctcgatctatcgttaactcggggtcttgcatttcatccaatcgctcttttgccacttgggccatccatagcttgaaaggttctgctttaggggatgggatggattggataagccggaacagctgttctgtcgtagctacgtcggttttgtagtatttcccatcggtagaaggtaatttcagttggttacaatttgtaaccgactcatttccctcttttcttagcctatgtttcaacaccttccagtaattgctaggattaggactatctgttaggatagcgacaacgctaggatcgtcatacttgccggtatcgaagccgtgattgttgaatgtgagaccactgttaaggtggtagttaaatacagtttctcgatcggggcttttttggtgaatctttttaattttgtacttttgtaagcttgcacgaatgttatacatgaataggagaattagacaatggccagcgatgatataaaacaggcatggaaagtgccggaacctacgttaaggaggttgccgtggtatcttgcgttcgtaaagttgatgaaagggaaaggggaagcgtttatctcatctacccagatcgctaaggagattaatgtagatcctagtcaggtcgctaaagatctctcttttgtgaatatctccgggaagacgagagtgggatacgatattaacgcgttggttgacgtattggaggatttcctcggttttacatcccagcataaggcatttctgtttggggtagggagtctgggcgcttctttgttgcatgacaccggactgagccaatatggtttggagatcgtggcgggctttgatgtccgtgaggatttggacgggagcatgatcaatggcattcccgtttttcatatggatgattttcctgccaagcagaaagaatatggcgcgacgatcggggtgatcaccgtgccggtggagaaagcgcaggaggtgacagaccggattatcgagggaggaatcaaggctctttggaattttacccccttccgtatacgggtgccggaacatatcgtagtccagaatacttctatgtatgcgcatttagctgttatgtttaatcgattgaactcaatgaatcactaaaatatgaagattatcgccgttggaatgaactatgccgctcacaataaagagctgcatcattcgttagaattatcagagcctactatttttatgaagtcggactcctctttgttgaaagatgggaaaccgttttttattccggatttttcatcggaagttcattatgagacggagatcgtggtacggatagaccgtttggggaaaaatatagccgagcgtttcgctcatcgttattataatgaggttacggtcggtattgatttcacggcacgggatttgcagaataaattgcgtgcgcaagggctaccgtgggagattagtaaggcgtttgataattcggctgtgatcgggacctttattccgctggagcaagcgggggatgtaaaccggcttccgttccatctggatatcaatggctcgaaggtacaggaaggcaatacctcgaatatgctgttttcggtagataagattattgcgtacgtaagtcgcttctttacgctgaaaataggcgatttgatttataccggaacacctgctggcgtaggtcccgtgaagatcgacgatcatctggagggatatcttggcgagcggaagcttctggatttttatgtgagatgagaagattaatatatatattcattataggtttattactttgctcatatacatgggcggatggtagccgttatgcttctaaatccctgttatcggaggggaaatgggtgaagatccgggtggataagaccggaatctacaaattatcctatgcggatttgaagaatatgggtttctcggacccatcgaaagtctctgtccatggctatggaggatggcccttggatgaggatttcagtaaggaatatatcgatgatgtcccttctacaccggtttggcgtgggagtgattacctgttattctacgggaaagggccggttaaatgggagtatgactcgtcgagccagacattcgtgcatacgaataatccttattcattgtatggctattattttgtgaccgatgccactccgacgaatgatatgacttccgtggctcaagcgagtggcgcgactaatcggatcacgacttacgatgattatttggtgcatgagcaagaattagtatcgttggcgaaatcgggtagggagctgtatggggaagattttagcggagctaccccccgaaccctatcaacattctcttcaattccgggaatcacgaatgaagacgctaaggtaaccatgagctttgtatccaaagtcacttccggtacgggagtcgcttctttgagtattaatcagtctaatgttctggacgtttcgatccgctcgaatagagaggaatatgtgaaggcgctagaaggggtaagcacggcggtatggaaaggcgagaagagtgagaaaaacagtgtggtcgtgtcttataattcggcttctcataacaatgtacggttaaattacgttcggttacattttaagaggactttgcagccgtatggggcctatactttttttcgtagtatagcttctatcggaaatgtttcccggttcgtggtacagggcgcaaacgcgaataccttggtctttgatgtgacggatgctcagcgggtaagactgatggagacggaattgaatggctccgaacttactttctctattcctgccggtaccttacgggagttcgttttggtacggacggatcagagctttatctctccggaggttgtcggtgaggtggagaatcaaaacctacatgccttggagcaaaaagacatgatcatcatagcggctaaagctttccaaacgcaagcggaacggttggcggaggaacaccgggcaacagacggattgaccgtggaagtcgtggatcctcagtcgatttataatgagttctcaagcggtgcgcctgacgctaccgcttaccgccggttcatgaaaatgttctacgatcgtagcgtgtctgccggtaacgctccaaaatacctgttattgtttggcgatggtatttacgacaaccggggaatttgctcggacgtgaaaaatatagcaagggataatatgttgctgacctatcagtcgagagcgtccttgtttgaatattcaggattgttctataattctaatttctcgtatgtaacggatgattattatgggctattggataatgtatccgaggaggcacttgataagccgaacagtatttgcataggtgtaggacgtttccccgtgcggacggtaacggaggctacccaaatggtagataaggtaatcggttatatgcggaacgaggacagaggcggctggaaaaaccaaatcaccttcgtggcggatgatggtaacaatgcggatcactatacgagtagtcatgcggaacaagctgatgagctggcccggtttatagaggaaaatcatggggctttcctaacgaataaagtttatttcgatgcgtttaagcgagataatagcggaacgtatccggatgtacgtaagcggatctctgaattattgaagaaagggcaactgttgattaactatacggggcatggtaatacgaccgcttggtctgacgaatacgtgtggacacagacggatatcttacaatctacttatacgaaactacccatttgggtgacggcgacttgcgattttacccgtttcgatgacgtgaatacctcggcgggagaatctgttttcttgaatgcgaaaagtggagggatcgcattgtttacgacaacccgtgtggttgtatctagcggtaactcggcactgaataaggaactttaccgcaatctctttgagagggagagtgacggacgggcccgtaccttgggcgaggccatgatggagaccaagcggaaactgtctggtatcaataaacttaattttattttgataggtgaccctgctttgagaatctcctatccggagtataaggcgcaagtgacagccgtgaacggcaaggccatatcagatgagccttttacgtttaaggctttggagaaaataacggtggagggagagatcttagatacgaaagagggcttggctaacgattttaccggtatcctaaatgctacggtgctggatagtaaagcttcattgaccaccttgggcaataatacgaatgaaaaaggagatacggtccgcttctcttacacagattacccgaatacgatctatatcgggcaagattcggtacggcaaggaaaatttagttttacatttatggtaccgaaagatatctcttattcgaataagcagggaaaactgaatctctacgcctcggatgaggtgaacaagcatgaggcacaaggatctttcttgaattatatcgttggcggtaccgctgataatgcggaggcagatacgatcggccctgagatccggcagatttacttgaatgattctagttttgtagagggtgatcaagtgaatacgactccttattttgtcgctaggctgtgggacaagagcggtgtgaatataacaggtagtagtgtagggcatgatatcatgctgacggtcgacagtatgccttccatgagttataacttgaataattactatgcactattacccgataaagaaggggaaggacttgtccagttctccatccccgagctggagccgggaatgcatacggccgagtttaaggtgtgggatatcttaaataactccacgacctatacctttacttttgaggtggcggaagggttgaaacctaatctgatcgagatgtatgccaccccgaatccggcacgggatcaagtggaattctttctgcatcacaatcgcccggagtcgaacttaaaggtgacggttatggtttatgatatgaccggtaagttcctatggagtaccgagaagagcggttcctccgagttgtttaaggcttatatcgtaacttggaacttgacggataacggtggcaggcggttgcgcccgggagtttatctgtatcgggcggcgattagtacgaataactcgaaagaggcgacgaaagcgaataaattaatcattctcgcacaataaagtatcgggtaattagtttataataagcatgggggtatgtttattaccctctaggaatgataaatgtaaatgtgtttttagaatagaatatatggtaagagtttcaagattcagtctgttactagcggttttcagctttttgacggcatttacggctttatatgcccaaggaggcgcagacgatgttaaacataaattcgccccgattaatacggcgataccgtctttgtctatcgcgcccgacgctcgtggaggtgctatgggtgataacggtgtggctactacgccggatgtgaattcccaatactggaacccggctaagtatgcttttagctatagtaaggccggagtcgccttgtcctatacgccttggttacgtaaattggtgaatgatgtggctttagcgtatctggccggttattataaattaggcgatagcgatatgcaggcgatcggagcttctttgcgttatttctctttaggagaagtacaggaaagccgggatggaggaatgggtaatcagctcatattgaatccttatgagatggcttttgatgtaagttatagccgtaaattatcggatgtgttctctatggcggtcgccttgcgctatattcgttcggacatgggtgcctcgtcggacgcggatatggttccggataacgcttttgccgccgatatcgccggttatctggagaaatacgtgatcttagggaatagcgagtgcctgtggagctttggttttaatgtctccaatatcggtacgaaggtctcttacgacggcggaaataccaaccaattcttgcctacgatgttaaaggttggaaccggtttgctgtatccgatcgatgattataaccaaatcggtatctatgtggatttgagtaaatatttagttcctaccgaacctattcaagaaggtacgactcccgaggatgaggctgcttataaggaaaaacatgatgaatataacaatatgtccccgatcacgggtatcttcaaatcattcggtgactcgccgaatggcttcaagggcgagttagaggagattatggcctctatcggtctggagtataattacaatcagcagttctttgttcgtggcggttattactatgagaataaatatcagggaaaccgtcagtatttctcggtcggtgccggtttccgcatgagtgttttccagttggatgccgcttatctgatcagtacggtacagagtaacccgttggaccagacattgcgcttctccttgtcgttcgatatggatggaatcaagaaccttttcagataaatgggtatgaagatacgtgtaggttttggttatgacgtccacgccttggtgccggaccgggaattatggctgggcgggattaagatcgagcatacgttgggcctattgggacatagcgatgcggacgtgctgatccatgcgatctgtgacgctttattgggagcggccaatatgcgggatatcggttatcatttcccggatacggcaggtgaatataagaacattgatagcaagatattgcttcgtgacaccatgaagcttttgagagaggcgggctatgagttgggtaatatcgatgccaccgtagccgccgaacgccctaaattgaatccccatatccctctgatgaagaaaacgctggccgaggtcatgaacgtggacgaggaggatatttctatcaaggccaccaccacggagaagctgggcttcaccggacggcaggaagggatctcggcttacgctacggtgttgatacagcgcatgggatcgtaaaccaaaaagtactcccttttccttcttccgactctacgccgatcttcccgtgaagattatctaggatcgtttggcaaatggatagcccgagtccggttccttggataaaggaatcgaatttggcgaaacgctcgaatacgtgcgggaggttcttccgctcaataccttttccggtatcttttacgtaaaagtataatccatcttccctctccttgtatcccatgcggatagacccttggaacgtgaacttacaggcgtttgtgaggaagttggtgatcacttgggtcaagcgattcttctcggaatagataacacaatcctgttcgggtatctcgcaatagagagtgacaccgtctttcacccggctttggaaggtctggtataagctccggaatagcgtggatacgttgaactcggaatagatgaaatccatttgcccggcctcgatcttcgataggtccaggatatcgttcacgagttgaaggagaagctcgttgttcgtctcgatgatctcgcaaaattcttttgtctcctcggaggggtttgtttgggcgagcaggttcgagaaccctacgatagcgttcagcggggtacgtatctcgtggctcatgttcgctaggaaggcggatttcaaccggttggattcctctatcttctccttgtccctcagttcttgttccatttttttccgttggttgatgagggtagtacctccggttaagtaggcgggttttccttccggatcggttttccctacgatcgcaaagatctctatccatgtatattcaagccctgtatcgtctaaataacggatctcctcgtcgatcgatatgctctcgccggcgattagtttattgatcgcgtcttgcatctgttccaagtcctcggggtgaatgccgctataaaactcgtccgccgacatgcagaattggccgtcggttcccttgtcgcgaatggatctttgggtcaggtaaatattgttacattcgagccgtgcttcttttacgtcccatatccatgtcatcatgttgctggctttcaagacgagctggtatttctggttcaggtcttgcgcttggcgtgcgatttgcagctccttgtctttggccttttgcttttggatgaagaggcggacccgtaagatcccgatcgttatcaataacgccagaatgacgagtaggcttatgatatggatcttgtatttctgtaagaaaccgggaggctcttggaaatacgtggcgttcgggggatataggccgggatcgatctggtgaagcaatagatgctggtaatttaggtaggccctcggggtttccgcggtctggatcgggatttccttactatctttccccgagaggatcatttcgatcgtgttgaccgtcacctgcgcataatcctccggagaaacataatatcccccggcgaaattcccgttttctgtttgtacgtcttgcaaggtaaagattggggggacggagaaactattggtcattttctggacgttatcgactaggtaacgattctcgttatccttccgggtcctgtaccatgagtaataaaggactccggtcttattgtcgaaagaggccagtctgtccaataagttctcggtggaaatggaggtggtagacagtggctcgaattggatgcccggaaaatctttccgtagcacggcctctacatccgctttcgtttgctggcttatataacggcggtcaaaaataaaggccagtttggttaattccggttgtagctttttgattagctcgatcgtttgcttgatatagactgggtattttataaaagtggcgttatagtcttttactacgtccgtgatgggaaccagcgtatcgagcacgtttttatctaggtctatcaggtactcttctttcgggtacatataatctctggcgtagcagatgatagagggaatatctttccattccttgtcaaacaacgggcgggcgacaagccaagagggatctcctatgcatacgactaaggtgggtggcacgggaactctctctaggatcattgttctcttctcttgaaacccttccatagtgcggataccggggatctgtaagggaatcgcctttacggtaaacccttcctccccgaattttctttctatatcaagataggtctgttttgtccagctttcctcgaagttgatggagtgcagtacgactatagacggtttctcgccggagcctcgtgcgctcatgttcaagtggaccgttagtataataaaaataaaaagaatgatatttctcatggccgttaattctaagcgatatatgtagcaaacgtgattctggtagcaaatgtagtgattccgctttattaagcaagaggtttgcctgaaaataaaggttttatatgtagtaaaatggtaatagttccatcttgataggatagccttttcgcccttgtttgcctattcggagattaatacgtagctttgagccaataaagtggtatttttatgaagaataatgattggaaagatcgattaggcgtgatgtactccacgaatcccgattttcaatataatacgggagatacggaagaggaagatacgttgccgaaggagaaacaagctttgcgcatatccttggataagcggaaccggggagggaagatggttaccttgatcaccgggttccggggcacttccgaggatctgaccgccttggggaaactcttgaaagtgaaatgcggcgtaggcggttccgctaaggacggggagataatcatccaaggtgacctgcgtgccaaggtgttggatatcctccggaaagagggctattcgaaaagccgtacgatctaatccccgatcgctatgctaacaatctatagggcttccgccggggcgggcaagacgcataagctgacaggggagtacctgatgttgctcttctcccagccgggcgcttatcgccggatcttggccgtgacgtttacgaataaggcgacggatgagatgaaaacccgtatcgttcaagaactttatcacctcgcttccggccgtgcgtccgattatatccagctactctcttccgcctattccttgacggagcggcaggtgagggagcaggcccggaagattctggtcgctatcctgcacgattactccgcttttaatatcagtacgatcgaccgctttttccagcaaacgatgcgtgcctttacccgcgagatcggcttgcaaggcggttatggcatcgagatggaccaagaactggtcttgaccgaggcgatcgataacctgctggccgatctggagaagccggagagcaaagatttgctaggttggctgctgcgtttcgccgagaacaagatcgaggatggaggcggctggagtttgcggcaagacatcatgtcgctcagccgggaggtctttaaggagagttataaggcatttagcgaggaagtaggtaaggatatcgcggataagcaggcgctcgatgcctataagaatgagctatacgccattatccgctccgtagaggcggaggcgaaacgtttaggtgaggagggagtggcgttgctgaaacagttcgccttacaaccctcggattttaagggaggaagtcgttccccgtttttctatttcgagaagctggcgaaaggtgagatgaaagagccgacagccacgttccaagctttgccggataatccggatgcctatacgaccaagacgactccaccgggtctccggcagatcatcgggtgtgtatatgaggaagggttgaatgcctgcgtaaagaatatcgtatccctgttcgccaacctgacggcctataacacggcccgggagatcgtacgttattattatacgttagggatcttaaccgatatctcccggcaaatcgccttttaccgggaagaaaagaatgtcatgctgatcgccgatacgaccgagttgctgaataaggtcatcagcggcagtgacgccccctttatctacgagaagacgggtacgcacgtagatcattatatgatcgatgagttccaagataccagcggcatgcagtggaataacttccgccccttggtggaggagagtctggcgaatggccgggcgaatctgatcgttggcgacgtgaaacaaagtatttatcgtttccgtaactcggattggaagctattggacgagcaagtccgcagggatttcgaggacgagcaagtccgtgaggataccctaaaggataattggcgaagctgccgccatatcgtggagtttaataatgcgttcttcaccgccgctccggcgatcctgcaggatctatataatgaggcgttgaaaaactcctcattaagcgaggaagagcgcacggccttttccgcgaggatcatggcggcctacgacgatagttcccagcgtgtccccccgcccttccagaagaaggatggacatgtacggatcgatttcctctccggtgatgaggataaggactggaaacaggaggcgatggagcgattgcccgctaccttggagcgcttgcaggatagcggttacgcgctaaaagatatcgccatactcgtgcgtaccaatcaagaaggtgctttagtggctgatacgttgcttgcctataaggaagagcatccgtccgaccgatacaattacgatatcatctccgatgatgccctgttcgtgggtagttctccggcggtccgtttcctgatcgccgtattgcgctatttgcgaaatccggaggaccggacgaacaggaaattggcgatgtatgcctatcaagtattaaccggaaaatttggggagagcgaggcggacgagtctgtttttcaaaaccttcagtctatctcccggcaatccttgtacgaggtaaccgaagggctcttccgtaacttctccgcttacttcccggaaacggaacaggtattcgtgcaagcctttttggatatggtttccgagtacgcccaaaaagaaagcgcggatttgaaccgtttcttgagatggtgggacgagaccggttatcgaaagacgatcgctaccccggatgggcaaaacgctatccgcatcttgaccgtacataaatccaagggcttaggttttaaggtcgttatcattcctttcggggactgggagatcgaccataagccgacaaagcccgttatcctttggtgccacccggagaagaagccgtttgaccgcctgcacttagttcctgtccgttacggacagatcctgagtagcacgattttcgccaaggattatttcaaggagcgcttgcatgctttcatcgataacttgaacaccttatacgtcgcttttacccgttcgaaagaagaactgatcgtattctccccccgtccgaggaagatcaacaaggaaggtaaggttgagaagataacttccatcgccgatctattgtgggcgggggtggagacggatatcgaggatgatacctttgaaaggggcgaatggtggcatccagcttcgggtagaacggcagaagataccctggaggaaatccccatgagccgcctgtattccgtttccccggatgatcgtttacaattacgcctgcatgggaaaggattctttttcgataatgccaggcggaagcacggtaccttgatgcatgaggtattgagccggatacgtacgccgaaagatattcccgcttcggtcgaaagttatcggttagccggggtgattaaccgggaggaagcggcggagttgatcagccgtctggaagaattattgcaagcggaggaggtaaaggcttggtatgatggttccgcccgtgtcttgaatgaagtggatatcctgttcggtaaaggcttgtctaaacgcccggaccgggtgataataaaaggaggtaaggttattgtcgtggattataaatttggcgaacggcaagataagcgccatcctaatcaggtaagaaattacctgcaattaatccgtaaaatgggtttcgagcgggtcgatggatacctttggtacgtagagttaggtaaaatagaggcagtgaataagtgatatatttttgatattcggtaaaaatgaatatttttgcagattcttagtataaaacgatacagtcaaagaagaatgaaagtacataaagaaggaaccggtttactgcttacgttgtttacaatattatttattgtgaatataactttgtaccatacggtaggtaagggtatgctgttttattctgtcgcttttgtttctaccgtattgttcctattggtattaaacttcttccgtagtcctttccgccggtttccttatgattcggaaggcttggtgatcgctcccgccgacggtacgatcgttgccatcgaggaagtgatggagaacgagatccttcataagaagtgcctacagatatctatctttatgtctatcttcaacgtgcatgctaattggtttcccgtaaacggtaccgttaagcatgtttcccaccagaacgggcgttttatggcggcttatctgccgaagagtagtacggagaacgaacgttcggcggtcgtgattaccacgaggaacggggtggatgtcttggctcgtcagattgccggggcgatggcacgccgcatcgttacgtatgccaagccgggagagaaatgtcatgtggacgagcaaatggggtttattaaattcggttctcgcgtggatgtctacctgccggtaggaacagaggtgttaatagagatggatcaaaaagtaacaggcaatcaaacgcctatagcccgtttgtcaaaatgagtataagaaaacatattcctaatacaattacgtgtctaagccttctgtccggttgtgtcgccagtgttatggccttgcacggaaatcttttatctgcgttgatttggattattatagccgcggtctttgatttctgcgatggctttgccgctcgtttattgaaggcttactcgccgatgggaaaggaattggattccttgtcggatatggtaagtttcggcttcgctccgggcatggtggtctattggttgttgggagaggcttctacggctttgccttttggctctttgaatacgtatatcccttatctggcgttcgtgatccctacgttttcaggtttgcgtttggctaagttcaatattgatgaacggcaaactacctcgtttatcggcttgccggttccggcgcatgctttattttgggcttcggtgggatattctgttttaccggttatccatgcgaatgaaggcttgttcgtgttggtgactgttatcttggcgtttattacctccttgctgttggtgtctgagataccgatgttctcgctgaaggtgaaatccttagcgtggaagggtaatgagcttcgctatatattgatcgcttgtgccattattttcgtggcgttatggggattcttgggaatctctggaaccatcctgttatatatagtcttgtctatttttaacaaaaagggataaacaagaattcttatctttgtgtttgtgatagtaaagaatcatttaagtatcggattatgtttaagtttttgtttgtaatattctttttctttatcctgttggtgtttctgatgggtttctccatcttgcgtacctttaagaacatcttttttggtagcggaaacagcactcgtaagggagaacaacgtcgtcaaacaaatagcaatacttccggacatcgttctacgactactaccgcccgggacgatgatgatgatcgtacaccttatgtgcaccgtaagaagatattcgccaaggatgaaggggagtatgtggattacgaggaagttaaatagagcttagcgtctttgcttaaagaaacgctgcatttcttccgcgcactctttttcaaggataccttttttgataatcgctttcggatggaaggcttgaggggcgaatttggagaaacctcttttatcatcggatgccccgtatacgatcgtgcttaattgtgcccatccgatcgcgccggcacacattatgcagggttccacggttacgtatagactacaatttgtcaggtatttcgctcctaagactccggcggcggccgtaatcgccaacatctcggcatgtgcggtcacgtcgttcaagcattcggtttgattatgcgccctcgctatgatctggttgttgcagacgataacagctcctacgggaacctcaccctcggacgctgccgcacgagcttccaccaacgcttgcttcatgaaatattcgtcattgaaaggattcatcttctcatctcattttcgttgaaaagagtcggataatcctcctccaaggtcttgaggatgtgagaaaggatcgtctctcggtaccaacgggacttattctcgatcttgtagcgtgaaaggtaacgttttaccgctttatgctcttcgtcattcagcataaaggtcactttgtgtaccctcggatgattggggtgagccgatgaatatttacgttcttctttcatacatttgcaaatgtacgagtgaatagccgaataacaaagaaaatggctatatttgtgcaaattaatgcgatggcaagacagaacgatatgggtcgggaaggtgagtctgaggctcgtgcctatctggtaaaacatggatataacgtgttgcataccaattggcattggcatcattatgaactggatattatcgctgtcaaggaagatgagttaatcgtggtggaggtaaagacacgctctgaggattttttgctttcaccggaagatgcggtagacaccaagaagattcggaggattgtcgccgcagcggatgcctatgtccgttattttaatatagacttaccggtccgttttgatatcgtgacattgatcaagaaagagacggggttcctgatcgaccatatcgaagatgctttctatgctccttgctgttaaaagataaacgttatgaatatagaagaagtacgtgaatactgcctttccttgaagaataccatcgagtgtttcccgttcgatgaggtatcgttggtctttaaggtagagaataagatgttcctgctgcttcctttggatgcggaggagcctcatgtctccttgaaatgtagtacggattatgtggaagagttacgggaacattatacggcggttgagccagcttaccattttaataagaaatactggaatagcatttatctggaccgggatatggaagacgaggagattaaacgctggatcttccattcttaccgggaagtgatcgctaaactaccaaaaaatataagggaaatttataatgatgagcactgataatgaatctccccgcatcttgcgtgtggcggaaaccgcttctacgaatagcttgcttcgtgagttggtcatcaaggaatctcttgcggaaggaagtgtggtcgttgccgatttccagacagccggacgtggtcagatcgggaatacttgggagtctgaggcgggaaagaacttgatgtttagcttagtcctgtaccctacgtgcatccctgcgaaccgtcagttcttgatttctcaaatagcagctctaagcgtgaaggaggcgttggacttatatgcggatcatatcaccgtgaagtggccgaacgatatttactggaaagacaagaagatttgcggaatgttgattgagaacgacctgtcggggcataatctgtattgctccatcatcgggatcggcataaacttgaatcaaacggtatttcgaggagatgctccgaatcctgtatctttgtttcaaataatcggtaaggaagtagatcgggaagaggttttgcaccgtttcctctcaatattctatcgctattatttatctcttctccaagaggaacacgaggatattcgagctcgttatcaatccgctttgtatagaagagaggggtatcatggttataaggatgagtccggcgagttcgaggcctgtatccatgatatagaatcaaccgggcatcttttgctagcattacgggatggaagcattcgccgttatgcttttaaggaagtctcttattgcaaatgactttttgatcggagtgattttttactacgtatttttataatgtacacgtacattataaaatgtgtgtaatagtgtatatctgttggaggaatgaaccgaagataagtattgtggtattggataagagatggtttgtctttataattggcggtttcgtaatgaatagcctatttgattgataagaaagcgtatatggtaacaaaaaaataatagggaagatttgcacgaatcaaagaaacgcgtacctttgcaatgatgaataaaaccgattgccctaagtccgtttaaaaggcaggcaatccaatagaagagcttattacactttagtattaatattaaattatttaattatgaacaaaaagttttctacgcttttggctggtgctgcatttttgagtgctgtatcagttaattctgtttatgcacagggggtgcaggataacagtttgccaacagaggctagtgcttatcctatcgttaagttagcagaaggaacaaacactggtttattccaattgaaaattaaggattctgacaaagtcttatcaatggataaggatggtaagttgactttggtaaacgttactacctcttcacagttggctaacactttatggtgtgtaactgttacttcagagaatcaaggtcagactcacaagtatgatttcatgaataagggaacaggtatgatgttggatataactatgtctgatatcgtaggtgctgaagaaagtacacccgttatccctacaactggaggtgaaatttctggttgggctttctctagagaaatcaataagttggaaccggagagacctctgttctctcatttctctgccgattctattgttggtttttcagtgaaaactaacgatgacaaagtttatgtgcagaaagagggagctaagaaagctgagacagctggctttgcgaagtttacattacaagctccgggtcagatttatttgagtgccgaggagttgaatacaatcttcggtgtgcaaaaggaggatgctggtgttaaattgacatttaataaggatgtgcttggtacaactttgacgaatccgtttaacgctaacaaattcttagcagaagaatctggtgatactaaatatttgtatatttctgatttgaagaaagaagcttatttaagagttgatacagcttatacaaatgaaagcggtacaaagttcttggcttacaattggacgaagaaaggtaaaacaggcgaagctatagatgcagtgagaggcagtaaaattcaagatcaacataaatttgctttcctttattctccggcttatgatagcttatatatctatgtgcattcaatcacttggaatgagacaaaagctaattgggagacacttgtaaaaaaaccagaggcgacaggtgataactggcgtgtttctttgcaagacttgatcaagaaccaaactcgaatcttgacggttgatgctaaggagcaaaatacacatatctctttcggcaatatggattgtaatccggttgcttctacaaagacttctgttgctgatggcgtttatttaattaagagcgctaagactggtaagtatttggcaatacctttgcataacgatacaacttgggtcaacaacgtagagaaagcaaacacagcagaatgggcgtctttggacttacaagatgctaatcatatgcctgcttatcaatgggttgttttgaaaaagaatgctgttgataaaaataatatttctccgatcgatgcttggaaccgtgagtataatacagtaacattgagttctgttcagttgaacaagaatgtaggtggtaagtatttctatattactactaacgcaggaacagtgcttgctggtgattctctagagttgatcgcagtagataagaagttctattctgataagtatcttggttataagaatttgactaaggatgagttgatggttaataagtatacgttcaactattggcatccgtatgctgctgataaatatatcgcagttatgaaagattctacgatgactgtaaaagatggcaagactccgtttactatcaagactacaggtaaagagcataagtatggttatgacgcttctttagtaaatggcgaaaagggtagaatcccgggattagctcaattggtaagaactatgtatcaagtttcttacgatggtgctatctttggtagctacgcagaggctaaagagaataagtatacagtaagtaaattgcatcaaactacagactctgtttacttcaaagaaaacaactgtatcgctcgtgaagaaggtgctactgttgctcattactatgcaattgtagaggctgacgtggatggcgttatccgtaactataaagctggtgtatctgactatgacgcatctgcttctttgaaggctcagactttgaaagaaacaagaacatctgcgttctatatcgctcctgataacactccgttgtatcgtcgtttcaacaatactcttgttggagagaatgctaatgatgctgctgatagcttgtatttcgtagagtctatccgtaaggagtacttaatggatgagaacaacacgaacctgcaacattctacagtggactacgctggtatttggaacaaggataaagctaatggtaaattggcattccgtgttgatactgcatggttgaaacgtggcgcaggcgagatcaaacctcaatacttgatttctgcattccaagatgtaatcgcaggtgagaagatcattccttgtacagaggatggtaagcacatcaaacctgatggaactccgacagagaatccttacgaatgtgtacacgctgttcatgttaagactccggcattcgtttatggtaagtacttagttaacttctctgattctgcagttgcttgcaaagctgacgtaaatccgtttatcttcaatacgaaagctgtttctaacagtagctatactcgcgtaggttttgttcctgctgttcaatatggtgatacattgttagtcttgactggcaagtatgcaaacatgacgaaagagcaattgaagaacgagggtatcgaatctatgatcgctacttataagaaagaatatccttcattcatcaatgatttgagaggtgacaaacataagaatgtaacttggtcattccgttatgtaaatcctgatttagctgctatctcttatgtagatggaaaagaaggcgagaataactcattcttgattgagtctaatgtatatgataaagctcatgatactcaataccaaactgtaaatggtgatgcaactcaggctatcgctccgaaggctgctgccgcttggttgaagatgcacaatggttgcttggtattgacagatgtgaatgctacattcgacaacgctaagactggtggcgacggtgcattggtattcaacgcattccagaagactgaagaagaagatatggtaacttctaatgacgaaatcgctactgaaggcgtatccgtagtagcaggtaacggtactgtaactgttcaaggcgctgctggtaagtctgtagttatcactaacatcttaggtaaggttgttgctgagacagttcttacttcagacaacgcaactatcgctgtacctgctggtatcgtagctgtagctgttgagggtgaagaggctgttaagacgatcgttaaataagtagaaaactgatcgaatttccgtaaggaaagacacagttcataaggtagagccccgtcgatgtatttcggcggggcttttgtgtgttgtgttacgagtatttctgtcgatgaaacaaacgttattctttctttttgattgatatatgtctatatgtatgacattcctttctggtggagagtataaaatagcagaggctggatgactgtaaacggtattttttattagaaaagccccctttttgtatgcgatagatggtgaaagcttatgcgataggtcgcattgggcaactccggcaatgccgttgggcatcgtgagcagtcaagaatagggttgttgatacttgtgaatgggcatcatacccctgttatgacccagttctaatcccataaagtcccttaatcaaccccttaaatatgaattacaatggataaatttcgctagaatgaaaggctgtttttcgataagagtctgtcacgtaaatgattgctgaaattttttctcgtattagagagtgagttgtccataagtccggaaaaatcgattctccgggagttgatattacaaattgtcaaaatggtaattgcggagatcctcaaaaggggaagcttggcttgtttaaaacttcgttatcatttccaaaaaaacacctatataccagccttataaccccctatttgatttattctgcttatatttgcgagttatcaacagttagggcgatttatcaacaaaacaagcattgttttgattgaaccctgtttggttcagtttttaatgtttagttttgccctcgaattaattaggtatagtatgggaaagattatcgctttagcaaatcagaaaggtggagtcgggaagacaaccaccacgattaatctggctgcgtcattggccgctcttgagaaaaaggtgctggtcgtagacgctgatccgcaggcgaatgcctcatccggtctgggtgtggacatacgtaatgtagaactttctatctatgaatgtctggtgaacggtgaggatgcgagcggcgctatcacacagactgaagtggaaggactggatatcatcccctctcatatcgatttggtgggagcggagatcgagatgctaaacttggagaatcgtgaacggatcttgaagcagatattgacaccgctgaaagagaagtacgattttatcctgatcgactgctctccttctttgggattgataaccgtgaatgccttgacagccgccgattcggtgatcatcccggtacaatgcgagtatttcgccttggaaggtatcagtaagctgttgaacacgatcaagattatcaaatcaaagctgaacccggcactggagatagagggattcctcttgactatgtatgattcccgcctgcgtttggcgaaccagatttatgaggaagtgaaacgtccgttccgtgatttggtatttactaccgtgatccaacgaaacgtgaagttgagcgaggcttccagttacggtaaacctgtcttattgtatgacgcggattcgaaaggatctatcaaccatatgcagttggcacaggagattgttgaaaaaaataaaggattatggcagcattaaaaagatcggcgttaggccgtggattagacgcgttaattacgatggatgacctgaagacaggtggttcatcgtctattagtgagatcgagttaagcaagatccagcctaatccggagcaacctcgatccatctttgaggaagagaccttggaggagttggctacctctatccgctcgttaggcgtgatacagccgattacgttgaaggaaatcggccccgagcaatatatgatcatctctggcgaacgccgttatcgtgcgtcgctaaaagcaggtttggagcgtattcccgcttatattaagacggcggccgacgaaaacgtggtggagatggctttgatagagaatatccaacgagaggacttgaactctatcgaaatcgcgttagcttatcaaaaattaatcgataattacggcttgacccaagaggggctgagcgaaagggttggaaagaaacgtgctacgatcgctaattaccttcgtttattgaaacttcccgccgagatccaagtaggattgaaggacaagaagatcgatatgggacatgcccgggcattgatcccggtggatgatccggaggttcaattagctttatatgagcagatattggctcaaggactctccgttcgtaacgtggaggagatggtgcgtaatatagccgagggaatacaaccggaattgccggaaaagaaaaaatcggatcgtaagccgatacttccggaagagtttaaattgctgaaagatcatttgtcccgttacttcaatacgaaagtccagttgacttgcaatgagaagggaaaaggtaaaattacgattcctttcgccacggaagaagagttggagcaattgatcgggttactggataaattgaaatgagaaatcgaatcatactccttttgatcggattcatgtgctatgccgggatgggtaacgcacaggaggataagacggagaaagccgttcctgctatagtttccgattccgtggaggtagctgccccggattctaccgtgcaagccgtcttgatggcggccgattcggtgggtgtaccggaagtgaagatgaagctggcttttaagccgaatccgacaaaagcggtcttgttcgccttggtaccgggtctgggacagatctataaccggaaatattggaaattaccgatcgtttacggtggcttgatgggatgtatgtatgccgtgacttggaacaacaagaactataaggattattcgacggcttataaggatatcatgtatgatgccgctaagaatctggaaaatccggatgcttggagtaaaagttggcaagacttgacttccatggctcctgaggatgcgattaataattcaaatttcaaggatcaattgaaaagacagaaggattattttcgtcgatatagagacttgagtataattattacggtcggggtgtatgcgttgagtatcgtggatgcctacgtggatgcccagttattcgattttgatatatcaccggatttatccttgcatttggagccggttgttagtccgaagacgagtgtcacgcctcgtacttacggattgaattgcagtctaaaattctgatatacatgaaaagatacctgctagcactcatttgtttaaattgtttggtctcattggtctatgcgcaggaagagacccgaattgaggaaaaagataccttaagctcgctggagtctgaggtcggattgattccggaaagcttggatgcgaacgtggatagtttgctccgtacttggcatgtgcaatatttctcaaaaagagaggacttttgccatgatgacgacgagaatgtctatttcccggattcggtctatatcgaccgcctgtctaggcttcccagcgtgatcgctttgccctataataatatagtgcgtgattgtattgacttatatgcggagcgtaaacgaaatttagtgcgttatatgctggggatggcggacttttattttccgataatcgagcaggtgttggatgagcatgacctgcctattgaattgaaatatctcgccgtcgtggaaagtgccttgaatccggtagccctctctcgtgtgggcgcttgtggtttatggcaattcatgcttcctacgggtaagagctatggcttggagattaatagcttggtggacgagcgccgggaccccttgaaagcgaccgaggccgcttgtaagtatttcaaggatatgtacgctatctatggggattggaatttagtgttggcatcttataactgcgggccgggcaacgtgaataaagcgatccgtcgttcggggggcaagacggacttctgggatatcttcccttatttaccgaaagagactcgtttatacgtccccttatttatcgccgccaattacgtcatgaattattattgcgagcataacatctgtccgatgcaaaccagcttgccgctagccacggatacggtcatggtgaataatgccctacatttgcagcaggtatcggatctattgcaagtagatattgagacgttgcgtgcgttaaatccacaatataaaagagacatcgttccgggtaatacccgcccttcggttttgaaactacctgcggcggaaacctatgcttttatcgataaagaagatacggtctatacgcatcggatcgaggaactgttggcgaattgcatttctgcgaataactctaatggctctttaccaagtggtgcgacccgggaaaaaatcacccacgtggtattgagtggtgagaatctttatacgatcgctaatcgctatggcgtgacagcgaaagatatccgtaaatggaacgggctaggctccaaccgggtagcgaaaggaaaacggttaagattatatgtagataatgggggtgtcgcttttgcctcggctaccaagactccggtgaaatcaactaccgtgactgcgaaatcgactgcgacaacaacgaaaaagtcggcttccgtcgctacaaaacagatcgcttccgctaataaagattttgtctcttataaggttaaatcgggagattcgctttattcgatttccaagaaataccctggggttaccgcctcttccttacaaaaggtgaatgggctgtcaagtccggatatccgtccgggtcaagtactgaagataccggtaggatgatcattcggggataattcgtctttaactcttttttttcgctttcttcctgcactggagaaggatgtgaatgattttttattcctttgtatacgaaaaaagatacaatcgtatgggttcattggatgaaaagatatcagtggtcaaggctaaaccttggttggtcagtttggtttgcgcggtgtttattgcctacccgaatttggcatggatcttttgtgacatgagctatctggctccgaacgatcatcaaggatttttactcttctttgggttccgttttctttacttctggggacttatttggtttttgctgaaaagtaacttgaggcatgaggattgtacctccttcttcgagcggttgctctggaatgccctgtacgtttccggaggctttgttgtctataaattgatctccttcctgactattagttatgatcgttttttgagtatcattatcttccagtttatcgtgttggcgttgttatgtaccttgatcggctatatacaaatgctatatcacaatcaacgggaaaaggatcaattgatcgagaatctgcgtgtcgagaatttgcagagccgctgcgatgcattggtgaaccagatcaatccgcatttctttttcaattcattgaatggaatctcctccttgatacggaagaaaaacgatgagaataccttgttgtatgttacgaaattgtccgatatattccgttatatccttcagagtgataaaaagaatttggtaccactgtcggaggagcttgcgtttatagaggcttttcagcatgtaatggtagtccgtttcgccaataagcttacttttacgatcgaagttcccgaagataagcggaacttgcgaattcccgtattatctttgcttccgttggtagagaacgtgacggtacataatattatagacagcgagcaccggatggatatcttgatccggctgaacgagcgaatggaactggttgtttctaatccaatctatccgaaattgaccttaccggatacgaatggaaccgggcttaagaatctggagaatcgtttcttgctattaatgaataaacaaatacgggtagaatctgatgaggatgagtttcaggtatacctacccctaaaatgatgctatatgagaatactgatcgtagaggacgagaccgccgcctatgagaacttagcggatatgttggttacaatagatcccacgcttgagatcatgggaaatacggagagtgtccagcaaacggtacgttggctgcaagccaatccgaggccggatttgatttttatggatattcatttatcggatggttccgctttcgctatttttgaccagatagaggtggaggcaccgattatctttactacggcgtacgatcaatatgcgatcgacgctttcaaagtaaacagcatagactatatcttgaagccgattaagtcggaagaattgaaaagggccttagataagtttagccgatggaatcatcaagatatcatccattatttatcccaattaacacagttgtctactactcctaaatacaaggataaactactgattcctattaaggataaattgttgcctattagcttgaaagatgtgtcttgtttctatacggctgataagaatacatatgtttatttaaagagtggtaattcgtatccatatgctaaaacattggaacagataatttcttctttaagtcctgctgattttattcgtgcgaataaacaattcatcatttctcgtgatagcgtgaaggacataacaatttggtttgatagccgtttgctcgttactttggatgtagaagtgcctgagcgtatatatattagtaaaaataaagcatccgagtttaagtcttggatagtaagtctggaataataattaaatagaaatgccggttctcttaaagccggtatttttttgcccttttcgtgttcaatccccattttttccttttcgtcaacaatcggaaacttcctatccgataattcttcatctttgcaatacaaacaaggagatacatcaataagatgtaagttgaaattttgatgttaatccgagttttatcatacacattagataggttaataggtttgtaaaaaaggattagtccgaaacaaaagaatgtttaggctatcttctctaaaatgagtgtttgttttgtaaatggttttgtaataggtaaattgtaggtattatgagaaagttaattatggcggtagcggttttgggaatgagtgctacaatgaattttgcgaaagcgcaatgtgtgaatgaatatgggaataaagaaccgtttgcggtagagtttagccgattgagttcttatctaggattggctccttaccaaatggaggaggtacttaacattaatgattattttgtacaagaacaaagaaagagtttgagcaaagacctgaagcgtcaggatgaacgattgcaaaaagccgtgtacggcaatttgaagctgatgaaagaggcgttgacagccgatcagtatcgcaagtatgtcatattgttaaatgtaactaacaacaataaccgattaaccggagctgtgacatttacggatatctatttggctgagaataaatgagtgtaaccttggctcgatgtgatgttgattagaaaggcgatccttgtgttcgaacagggatcgccttctttgcttctgtccttttccttttggaagtgcgctatcagattttagcgaaagcttgatccagatcatctataatatcatctatatattcggttccgatgctcaagcgtacggtggatggtgttatgtgctgttgggcaagttcttccgggctcatctgggaatgagtggtcgtgtatggatgaatgacaaggctctttacatcggcgacattcgctagtagggaaaatatctccagtgagtcgatgaatttccaagcggcttcctgcccgcctttgatctcgaaggtgaagatactgccggcaccattcgggaaatatttattgtaaagttcatggtccggatgggtaggaagtgatggatgattcactttttctactttcggatgttttgataaataatccacgactttcaatgcgtttgctacatggcgctccacgcgtagggataaggtctctaatccttgcaacaatataaaagcattgaaaggagagatcgttgccccggtatcgcgaagaatgaccgcacggatacgggtgacaaaggcggcggaacctgctacgtccgcaaatatggctccatgataacttgggtctggtttggctaatgtaggaaacttatcggcattcgccttccagtcgaaagtacctccatctacaattacacctcctaggctactgccgtgtccccctatgaactttgtggcggaatggatgacaatgtcagctccatgttcgatcggacgaatcaagtagggggttccgaacgtattgtctacgattaatggaacatggtatcggtgagcgacttccgctaccgcatccagattcgttacgtcagagttaggattcccgaatgtctctacataaatggctttcgtgttttcccggatggctgcttctaatgcgtttaggtcatttacattgataatcgtattagtaatgccttgggaggccagtgtatgggtgatcaggttgaaggaaccgccatacaaattatcggccgcgataatatgatctcctgccctcactatgttctgtaacgcataggtgacagccgctgctcctgaagccacggccaaacctgccacacctccttctaaggcagctacacgtgcctcgaaaacgccttgcgtggagtttgtcaaacgtccgtaaatattccctgcgtcacgtaggccgaaacggtctgccgcatgttgtgcgttatggaatacataggaagttgtttgataaatgggtactgcacgtgcgtcggttgcgggatccggttgttcttgtcctacatgaagttgtaatgtctcgaaatgtaacttctttgttgccatagtcatcttgtttatttagttcttattctgttggcaaatgtatgatgtgtgtgctttttggacaagattcgttgagaatatagaaaataatactatttttagggctataaatagaatacatcttcggcgaaggacgctggggaatcaatccgatagaatttttttcttatgaatgtttcagataagttagacaaggtggatctgcaaatcctccgaacgttacaagataatgcccggttgactacgaaagagttggcggcaagggtcagtctctcgtcaaccccggtgttcgagcgtttaaaacgtcttgagaatagtggatatataaagaagtatatagcggtactagatgcggagaagctgaatcaaggctttgttgtcttttgtagcgtgaaattggttcggctgaataaggatatagcttttgagtttacccggattattcaagaaatccccgaggtaacggagtgctataatatttcaggcgattatgattacttattgaagatacacgctcccaatatgaaatattatcaagagtttattttaaatgtgttaggaacgatcgatagtttgggctcgttgagaagtacttttgtcatggacgaggttaaacacgactatgggatccatatttaagcagtagatattctatttttgtcttttgttagggtttccttccaaatatttgtatatatttgtggctatacagtataaaaatgggaggtgtaaaaccatggacgatacaaaggacacaaaagatataaaagaaacgggcgaggctgcgtccgttctctctgcggacgaacagatgatacaagatgggttcaatgcgttgttgaacgattatttgaagtcaaaccaccgccgtaaggtcgaacgaatcacgaaagcttttaatttcgccaatcaagcgcacgccggagtgaaacggcgttccggcgaaccttatataatgcatcctatcgccgtggctcgtatcgtatgccgggagatgggtttgggctctacctctatttgctctgcgttattgcatgatgtcgtggaagataccgagtatacggtggaggatatccgggatatgttcggagacaagatcgcccagatcgtggatggcttgacgaagatatccggtggcatttttggggaacaggcctcggctcaagccgagaacttccgtaagttgctgctgactatgagtgacgatatacgggtgattctaatcaagatcgcagaccgtcttcataatatgaggactttgggttccatgcttcccgccaagcaatttaagatcgcgggtgagactctttatctgtatgctcctctggcgcatcgtctgggtctcttctcgatcaagacggaactggaggatttgagttttaaatatgagcatccgcaagaatatgacttcatcagcgctaagttgaaagcgacagaagagagccgtaataaattattcgagcgtttcgccgcccctgtggacgagaagctgaaatcgatgggacttcagtatgagatgcgtgcccgtgtgaaatcggtctattccatttggaataagatggaaagcaagggtgtcgctttcgaggatatttatgatatttatgcggtccgcattatttttgacccgcttcccggtgtggacgagaaaaaccaatgttgggatatctactcggctattacggatatttaccggattcgtcccgaccgtatccgtgattgggtgagccgtccgaaagcgaacggttatcaagcgcttcatctgaccgttatgggaccggatggacaatgggtagagatccagatccgtagccgccgtatggatgatatcgcagagaaaggcttcgctgcccattggaaatacaaggaatccaacgtggaggaggatacggaattggataaatggatacaaaccattaccgagatcttggagagtccggacccgaatgcgctggatttcttggatacgatcaaactgaacttatttacttccgagatatttgttttcactccgaaaggagatataaagacattgccccaaggggctaccgccttggatttcgcttatgcgcttcactccgatatcggtaataaatgtattggcgctaaggtaaaccatcgtttggtgccattgagtcatccgctgtccagtggagatcaggtggaggtcttgacttcccgctctcaggagccgcaaccggagtggttgaacttcgtgactaccgctaaggctcgtgcgaagatcgatgccgtattaaagcgtgtccgtaaagaggtcgctaagtatggagagataaaagttcttgatgccttcaagcgttcggagcttgaggcgagtacatccaatctggataaattaggcatgtactttggattctcgaaacgcgaggaattcttttatgcggtagagaagggggatgtggttttgcccgagaatttaaagaagctgttgaaggagaagacggataatgtcttgtttaagtatgtgaaacaggcgttgggtgtcgcttccaagaaggtgaaacaacccgaagaggaggaagccaagaaagagaagcctaaatatgataagaaaaagccttatttattgaaagaggaggcttttgagcgtaattatgtaattgccgaatgttgtaagccgattccgggagatgactctttaggttttatcaatgacgatggaaatgtagtagttcataaacgttcctgcccgatcgccatgcgcttgaaaagtagctttggcgaacgtatcttgaatacggtttggagcagccatatgaacgcttcttttgaggccacgctagaggtgaaaggtatagactcgataggcgtactgaatacgatcacgaaaacgatttccgaggatttcaacgtgaacatcatgcgcttgctgatcgaggcgaaagacggcgtgtttgaaggtaagataaagatgaaagttcatgacgtagaagatatccagaaaatgtgcgtgactttgtcgaagatacagaatattaaatctgtcggacgtgtagcggattaagtgtagcgaagtgcttcgctacacttttgttttataaaagctttatcagccgacaatcaaataagttatataagctatataacaagcgatcaataggattccctccggcctagtgatggtccgtttcttgaagaaaaggccaaaaatataaagcaatacgcatgaaccgatcatgacgcccaaatccagattggtaatgccttgtatgttcatcggcgtgattgtcgcgctacaacctaatacgaagaatatattgaagaggttggaaccgataacatttccgatcgccatctccgggttcttctttaatgcggccacgacggaagtcgctaactcaggaagagaggttcctccggccactaaagtcaaaccgataatagattcgctgacccccagcccacgggcgataccagaagctccatccacgaaaaattgtcctccgtaaatcaaaccggccaatccaccaatgatgaataaactcgctttccaaatgggcattattttaatcgtgctctctccattttcctctccattatgcgcgatcgcgaatgtatagccaaggaaaatggcgaagaagcataatagtaacattccatcgctactactgatactattgtgcgatgcgccgttgatcaaaacgtcattcgcgcaaatgaataatacgattgaggcaagcacgcaaagagggatctctttgctcaacgtacctttcgtgacgctgatcggcacgatagcggccgtacagccgacaatcatcaaggcgttaaatatattgcttcctactacattaccaatagcgatatccgagcttcctttcaaggcggatacgacactgaccgttaattccggtgcggaagtcccaaacgccacaatagttagcccgattactaagctggaaatattgaagcgtttggctaccgaggcggcaccatccgtcaaggcgttagccccgactaaaattagtagtaaaccgccaattagtaatacgatatccattagtctttagaatggcaaatcatcgattggattggccggcccgaaatcaggagcggatgaggctggagccgtaggagcggaagccggagcgaaattatccggagttactcccatcggagcggcttgaggagctgccgccatcggacggtctactttccatgcgttgatactggtgaaccagcggccttggtactcacggctgtcaatgtcgaaagagactgtcaattcctcgcccggctgaatggccgcttgagcgatcttatccgctccgaatatctggaagcatactttcttgggatattgatcgtgtgtctctaatacgtactcttgttttttccattcgtttccggctttgctgataccgcctacttccggtaggacctgaatgatttttcctgtaatttccatgtcttgtattttatttacttatgttttatttaatgggggacgaaggtacggttttgttctgattttatcaacagaataatcacactttcggggcaaaagcatcgaatgcgtctttcatagctaacagctcttctttgatctgtttcaggcggtttacgatctcttcttggcggatcgtcgtctctttattgtccttcagtttttgccgtgcgccggccaaggtcatccctctctctttaaccagatggtagatgaggcgtaccgcgtcgatatcctcctgcttgtaaaaacgggtacctttgctcgtcttccttggattgatgatatcgaactccttctcccaaaagcgaagggtggactcgttcacgtcgaacatctgcgccacctcgctgatggaaaaatagagcttgagatctttattcttttttagactcatactgctaatgaagtttaatccataacctgaccatgattctcggcgatctggatcatacggtcgtattcctcaggtgagagatccatgtaatagtatttggacggattatcatgctttcctcgtacgattacctcataatgcaagtgagggccggtagatttcccggtatttccaacctcgccaatcacctctccacgagtaaccttctgtccgacacgtttcttgaacttactcatatgaccgtataacgtctgatagccgtagccatgatcgataatcaaacaatttccgtatccctgtttccaagcggcgaaagtgacaacgccattacctgtcgcatagatctccgttcccactttagccgagaaatccattccggaatggaaacgaggtgtacggtaaatcgggtcgatacgtacgccatagccggaagcggtacgacgcagatccttattggaaatcggctggatcgccgggatacatttacttctctcttcttggttctttcctagagagatcagttcttccaaggaattggattggatatataattgcttacgtagcatatccatcttttgggtcgtggagacaacaagctccggattggacaggctcatcaaatgctcgtaacggtttgtccctccaaacccggctttccgaacggactcggggatggactcggcttggaagatcgcccggtacagattctcgtcacgctgttggatatcatccaatacgtctaacgcgttatttaagcgaagggaaagcacctcgtattgagtttgcaataggcggttctccttacgtaactgagattccatcggagagtccaccaaatgcatcatgacgaaaaaagtggctacgccgaacgctattccggtgcttaaatggcggagaacggtgaacagccggtctttgctagatgggtatacacgctcataattgagagtgttcggattgtataaatagtatgttttgcgacttttaaagagtttcatctacattttttgttatctgaatgcacgcaaaaataataatttgcagtacttttgcaaattgtttttcagaatattaacgagaactatataaatagattatgttgacagcaaaagaaatccgtgaatccttcaagcaattcttcgcttctaaggaacaccagatcgtgccttccgctccaatggtggtgaagggtgaccccacgttgatgtttacgaacgcgggaatgaatcagtttaaagatattatcttgggcaacgtgccccgtaagtatcctcgtgtcgcggactctcagaaatgtcttcgtgttagcggtaagcataacgatttagaggaggtaggacatgatacctatcatcatacgatgtttgagatgctcggaaactggtcgttcggagattattttaagaaagaggcgatcaactgggcttgggaatacttggtagaggtattgaagctgaatccggagcgtttatatgccaccgtattcgagggaagccccgctgaaggcttagatcgtgataacgaagctgctggttattgggagcaatatttaccgaaagatcatattctgaacggtaacaaacatgataacttctgggaaatgggggatacgggtccttgcggtccctgttccgagatccatatcgaccttcgttcggacgaggagcgtgcggcggttagcggcgccgatatggtaaataaggatcatccgcaggtaatcgagatctggaaccttgtgttcatgcaattcaaccgcaaggccgatggttctttggaaccgctgccggctaaggtgatcgataccggtatgggattcgagcgtctgtgtatggcattgcagggtaagacctcaaattatgatacggacgtattccaaccgattatcaaggtaattgcgggaatggcgggtacgacttacggtacggataaacagcaagacatcgccatgcgtgtgatcgccgaccacatccgtacgatcgctttcgctatcacggacggacagttgccttccaacgctaaggccggttatgtaatccgtcgtatcttgcggcgtgctgttcgttacggttatacgttcttggatcgcaaggaagcgtttatgtataagcttttgcccgtattgatcgagacgatgggcgacgcttatccggaattgatcgctcagaaaaccttgattgagaaggttatcaaggaggaggaagaatctttccttcgtaccttggaaaccggtatccgtttgctggataagaaaatggaggagacgaaggctgcgggcaagacggtcttgaatggcgtagatgcctttacattatatgatacctacggattcccgttggacttgacggaattgattcttcgtgagaacggcatggaagccgatatcgaggagttcaataaggctatgcagaagcagaaagagcgtgcccgtaacgccgccgctatcgagacaggcgactggatcacgctgaaagagggtgaatgtaagttcgtgggttatgatttgttcgaatgcgaggcagagatcttgcgttatcgccagatcaaacaaaagaataaagtattataccagatcgttctggatcaaaccccgttctatgcggaaatgggtggacaggtcggtgatacgggttggttgatcgccgacgacgagaagatcgacgtgatcgatacgaaacgagagaataatttgccggttcatttggttactaaactaccgaaggacgtaacggctacatttaccgcgaagatcaacgtgaaaaagcgtatccagtgtgagtgtaaccactctgccacgcaccttttgcatgaggcgttgcgtgaggtattaggtacgcacgtagagcagaaaggttcgtatgtttcgcctgattctttacgtttcgacttctctcatttccagaaagtgacggacgaggaaatccgtaaggtggaaatattggttggagagaagatccgtgcgaacttcccgttggaagagcatcgcaatatgccgatcgccgaagcaaaggcgctaggggctatggctttgttcggtgagaaatatggcgatgaggtacgtgtcgtgaaatacggaagctccgtggagctatgtggtggtacgcatatcccggcaaccggtatgatcggttctttgcgcgtgataggagagagctctatcgccgcaggagtccgtcgtatagaggcggttacggccgagggcgccgagcaattcgtatatgcccagcaagatctgatccgtgagttgcgtgcgttgatgaaccatatgccgaatttggcgcaagcgatgaaaaagtctatcgaggagaacgccgagatgaagaaacagatcgaggattatatccgtgagaagtctatgcgtttgaaagaggagatcgtggcgaaagcttcggagagcaatggtatcaaggttatgcagttcgttggtaaggcaaatgcggacgctatgaagaacgtggctttccagatcaaggcggagacaaccgatagctttgtctttgttgccggtatcatagacgataacaaatgcacgctcatgcttatgttaagcgatgatttggtgaaagagggcttgcatgccggtaagatcgtaaaagaggccgctaagcatatccaaggcggtggtggtggacaaccccatttcgctacggccggcggtaagaacatggagggcctttccattgcggttggcgctgtgaaagaggctgttggagtacagtaaaatcggttcggaagaaattgacttttctttcggacttaatgatagattccttcggatcgaataagaattccatccgaaggaatttttttatgtcgttttgataatcggaatacatgttttacctttgtggtctaaggttttaaataaaaaagatatgtcagagcaaaaagtggttatttgcaaggacctgaaatcggaactgcaagattttctctcctctctaaaatacgataagttgttcatccttatggatacgaataccaaagagaaatgttttcccttggtagaggatataccggcctttcaaaaggcgccgattctcgtgatggaagcgggtgatatgaataagggttttgtctcattagcccagatatggacagctttgtcgaatgagggggcttcccgtaactccttgctggtgaatttgggcggcggtatgattacggatatgggtggttttgccggcgctactttcaagcggggcatccgtacgatcaatatccctacgaccttgatggcgtccgtcgatgctgcggttggcggtaagacgggtataaacttcaatgggttgaagaacgaggtcggttctttttatccccccttgtgtgtattcatcgattgcgattttttgcgcacgttggatcgcgataatatcctttccggttatgcggagatgatcaagcacgggttgattagttcgatggagaattatgcgtctgtcatgctttttgatatcgacaccatgaattattcgtatttgaatagtttggtaggccagtcggtcgccgtgaaagagcggatcgtagaggaagatcccaaggaacaaggtattcgtaaggcattgaatttcggtcatacgatcggccacgctttcgagagcttgtctttcctgaaaatgcgtccgatcttgcatggtcatgcggtagcggcgggtatcgtgagcgagctttacctctcgcataagctgtgtggcttcccgatggagaaattgagtcaagtcgtttattatataaaagagtattatccggcgctcttctttgactgcacggactacgataccttatatgagttaatgacacatgataaaaagaatgagggcggtatcatcaacttcactttactgaaaaatgtaggggatgtccgtatcaaccaatcggtcaccaaggaaaaaatcttggagtcccttgatttttatcgtgaaagttttggcatttaacggaaaaaaactacctttgcacccgtaaaataaaagcgggatgtagctcagcccggttagagtacgcgtctggggggcgtgtggtcgctggttcgaatccagtcatcccgactaaagctgagagaaaaggagttaagtctatggcttaactcctttttttgctctctatcactttcctaaaacaatgaggcagtagaaattccgactcatccgatattcatgggggatagccttaaatcatgacaatagattaaaattgatatatttccgtttgaatttagtgcggtcattccagcctattttagccattatttctgttaatggttgcttagtgccgacttatcggtgcatgctctgtgagttcaaagtcttttggggcacgattgtttatcggagtagggaggcctagctgtttgatagagtgccattggctgctgaagtgaataactaacggcttgtcgaatgaataactagcggctatatatagccgctaactaacggctcgggaagtgaataactgatcacttggaaagccttctacggcctgcgaaatcaagtatgcgttaacctagaggaggatttttggaaattatattatatatgtacacgtacattaaagaatatgatgtatatgaataggctttagtaatacataccaataatatcaaggactgatttatctaataaaacggctagtataaacgatcgttttaattcgtcatttgcaaaggtacgcgtttctttgatacctgcaacccttccgagctatttttttcatcccttattcgctttcttatcaataggatagcctatcctttacgaaacaaccgattccgtaaacaaacctcccgttttccctcttcaaaaacgcaagatctaaatgatggtctagactagtcgttttggtatggcgaaggataattaaagagttgggagatatttaattaacactattattaatatttaaattagagattatgaacaaagggatttttactttgatgacagcggctttattggcctctggatcagttgtaacacctgctttcgctgaagcgacgtttgcgacttatcaagccgtgaacacgaacaaggttttggcgaacggtgtgaagttctatttgcaggtaggcagcgatgaggctacctccactcaaactgatacgaagtattacaaagttaaaaagttaacaattaaggacaaggctacggtttggtctttagaagagactttaaaccctgacgaggcttctgttttcgaggttggcaattacactaaggttggtggacagtacaccttctccttgtctgttgacggcaataagatttctttgacgaaagacggtgtaattaaatcagacgctgctactactacagaggcttctaaaactgtgactactttaatcacagacaagaacaaattaagcgaattgaaaaaattctccgcttctttgatgaacgctacggctatcaacgtggttttggctacacaagaagaggtgatgacggctgatatgttgaacgactacaacacggaaggtttcactttcggcttcaacactaagacagacttggaaggtaacgctttcgctaaaccgatgtatgcggtagagatcggggacgatgctactactttagatgccggtacttatttcgttgtaggcggtaaggatgatgctgttaaggcattgaaaaaagcagtgaaagataaagaaggagtagaggaggccttggctacggaggatatccaacttcttgctttgaatatagataaaaaatatgacgtaaggggcgctaaatctccggcttacattctacaggttatcaacggtgataagatcactgggaataaggcagctttctctgttaaggagttcgataagttggcgaatgaaggtgagtatgagctgaaaatagaagatcctaaacaagataagactgtagagggaactgaatatgtgtacgtaggtgctatgcgctttactgctacagatacgaagacttatgtgacaacggttaaggaaaatgagaaatctttattgatctccgctactttaggcgctagcacttatttggatgcttccgttttattgaaggaaggcgtggctaactacgtgaatgtttactttactagtaacaaggaaagccaaaaagataacttccagactgagtatcacaaatatttggttccggtaactgttaaggaggagactaatagagctgctacttataagtttgcgttcgacgctaaggctgctaaagacgtaaacttcaactctgcgttatctcaatgggccgtgaagggcttcgacggtaaatatacatttacgttggtgaaccgtgaaacaactcaagagattactttaggcttgcaagagtctgacgtgaagggcgagtataaggtggttaacgctaagtctaatagcgccgatgtttctttcaattccttgaagaaagctgctccgggtgaagagggtgctgatgaggctaaacctgttaatagtacaacagttaagttcatcccggttgagaaagtcgctggtttcttggatttatccaaggatgagatggaagctggtatcaagttggaatttacgggtaagactgcgttaattggtgagaagactttctttgctaagaaagacaagaaaacagaagacgaaacaacaactgaaatgttggctcctagcatgaaggcttccgatgcattcacgctggctatcaataaggctaaaggtaagatcaatgatgaggataaagatgctgtcgtaaattacacgatccaacctcttgtattatcttgtttgaaagatggtaagattgtagagttgaaagatacattgtttgttccgacttacaatatctattatacgactccgcaagagggtaaagatgatatcgttacttacttaggtgaagacttggaatttgcaacggtaagcggcactgaaaaacctgctgaattcgtattccgcgcaaacgctgacggttcttacgctatgatgggaactgacgcaaatgtttcgtttgatgaggatatcactgccggtacaaacgttgtaagcgtagatcctactacaggtacaaaattctcaacagaggaggtattattatataacctgtcagaaggcagcttcgctagcgtagctgttaaggtacaagataattcagacaagactacattgcctgctgagtctcgtcacgcttcattcgacaatgcgctgggttctatcaactatcagttgaataagaatggtatcactgagggtatcctttccgctgagagcatgatcttctggttggatacagcggatagcaaggctacaactccgtacttctatatctctaagggtattgaggttgctgaaggcgaagagaaaccggccgagagaatgttcatgtataacgctacagactctatgtctatcttcgatgagaactctgctcaggcttctttcaacgagaagtatatgctggaaggtacaactaaagaggataagatcgctaaggtaatcttccgtccggctactatcgcaggtgttgacacgatcaatacggttgtagagggtaaggctgctgttgttgctgctaaggaaaacaaggcagaagaagtattggctggcttggataacttcaagttcggtatctgcttggctgacgatgctgtggatggcgagtatgttatctactcaaaggcagataacaagtatgtatacgctaagaacggtaagttaggtttgggtggaaaggaagaggctatggtcttcacgttaggtactgaggttccgacttctaacgagtctatcgacaacgccgcttcttctatcgtagtaacaggcaacgccggttccgtaacgatccaaggcgctcaaggcgagacggcttatgttcgcaacttattgggtatgccgttggcagagacagttgtcacttccgataacgctacgatcgctgttcctgccggaatcgttcttgtaacggttggcgacgagaccgtaaaggttgtcgttaaataagacatgtaaaggaataatgaaaagataaatcgaaaatcattcccgtgcgggaaaccaagtaccccgagagggcgaacaagcgggaatggattaatattaatactaaagtaataaattaaagttcatccgtaagtacttccgtgaggatggaaacggatcaaaggcaaggggagacagtattgcgctgtttccccttatttgttgataagggtagataagggctttgttggtgaaatggacggtattcgatctttttgattgatataagggggatatcgtgacataccctttttgagagaggtatgaagtaggggagatcggaggggtataaatagcctttttcatgcaaaaggaccactttttacacacgataggtggtaaaaggcagtgcgactagtcgtgtttggcaacgacagtagtgccgttgggcatcgtaaacagtcatgaatagggttgttagtactcatgaatgggcatcgtaaccctgttatatccctgtcgtaactcaatgagatagcccggataagctataggatatgaattaggatgaattaaattcgctaggataaaaggctgtttttaactaatgccgtataagacaaatgattgctaatattttttctcgtatttggggataagctgtacgtttgcccgaaaaaagtgattctcgggcagttgagtttacaaattgacaaaatgccaaggtgctttttttgtgagcttataggaagggctagatccgaaaataaaccttgattttagagaatggcatgggataaattccatgcttgtacgtgctttattccttctttggaaggaagcggcagatcatcgagcgagacaacgatcttctcgtaattatcctcaatggcctctaacgaggcatattcccgttcgatggtttctttgtcgattagtaaataagtggattggagatagataaccctctctcctttgatagcgacgaaatccacctctttgttctttatgctgcctacgtatatttgatagccggcccttaataaatctagataaatgaggttttctagtttatacccaatgccgtagccaaagccttgatataaataattgttgaaacctaggtcattgatgtaatacttacaattcccggcgatggtctcctttcccttgatttggtatttctcgactttatgtaccaaaaaagtgtcctctatgtaactaatgtaggaggcgatcgtatcatagctggtcttccttcccgagctcttgaaataattggtgatattccgaattgatattaaattagatgcgttatttaccagatagacaaaaatgtcctcaagcaacttagcgtcttttatgttttgtctttgtatgatatcacgtagtaatacggtgtcttttaatgcggatatataatttctttgtacttctggttgagatagatggtataattcaggcataccactactttgcatatattctaggtagtgtaccttgttgttttctttttgggtgattccaagaaactctgtgtatgaaaaaggatagatggcaaattccacataacgtccggctaataacgtggcgagttctccagatagcattttagagttggagccactaatgaataactcatattcggcggtatagtcctgtgagtatgagttggcgaagcgttcccatccctctacattttggatttcgtcaatgaacagatagatacgaccttgaggatttatttgttttaagtagagattaaacagggaatcaagatcttcattggttttcaaaaaatagaaggcggatagctcacagttaatgaagaatatatttcggggatttactccactattggcgagatggctagctaactgacgaaggagatagcttttccctacacgtcgctgtcctaccaagactttgattaatctgtttccggtgtaggataatatcctatctaaataatcttgccgtttatagcctgttggaaaatcgtttccaccccataggttatacttctctaatgtcttaaatctatcgtccatactcgaaacttttgcgtaaaagtacaaaagtttcgaatgaactcgaaacttttcccgttaagaatgggatatacccttaaaaaataacggcaaccgccttccgccgaaagccgagttgccgttcaaagttaggaataaggtttggtttgttcctttgtaatgattctaacattaatatgtaatgagagttttctacattttatcgatacaaaagtaaatgccacttgttacgatttgattacgggagtgttacatttttagtaaaggtctcgccaaatcggttgataaccttgatctgtacgtctttgactccggctgaagggtggcaacggaataagtgcgatgtatgatatccggaaggttttccgtgcatgtcgatatagtcttggtcttcatcatcgaattgctccatgcaacctttctctatgccgttttcgctccatgtaacttggtaggtcgggtcccaatcccatacgttcaccactaggtaatccgcttgcgatttgaactcattcggcctataaaccctgaattgataatccgaatcatggccggttgccttataataccaagtagcggcattccctttcacctcaacgaccagataaccgttcggggcgccgcaccgatttacatggccggcccaccaagctccgcaagcggctccgatattatgctcgtacagattcggtgtgacttggttgttctcgaagaaatgcgtatgcccggcgaagatatggacattataagggctgacgatctctttcaggctctcagcgtcctcggcgtttcctccccctttatccgtctggttgaataccggggcatgtacgttgataaatacaagtgttccgggtttaacgtaactcaggtcgtttttcagccattccagttgttcctttccgaagcgttcgtcatatttcttgtctttataataatcaatatcttttaaggtgatgatatgtgcatccccgacattgaacgaataattgtaagggccgaaatgatcctcgtagatacgctccgcatagctctcctcggttaccttttgattggataaggccgggtaacgtaagtcgtggtcgtgattgccgatcacggagaacatcgggatgcctaagaccgagaccgcttccttataaggagtgaataaatccatgcgatcccaagtaatgtctcccagcgccataccgtagacctcttttccttggtagcgctctatagtctgcttcaagtcggggatggtctcttcacggaaacgtttcatctgccgttcgtcgatggtctgaggatcggagattgccaagtagacaaacccgtcgattggctgtttcctaggggtgagcgtaaaatcatattcattgatctccttacttttatcaagttgctgatagaaaagatccggtataccttttgtttgctcgatctcatagtcacccggtacggagaggtagacaaagcggcttttgtccagattcgaatctaggctatattctccccgctcatttgtttgcgtgaaattataaccatccgtaacgactacgccttgtagcggtttgcctgccgtatcggatacagtgcctcttacggtagcggcttgcgctatccaagtggataacgcaagtaaaagcgtgaatgataagaattgtttcttcatcgtaattttttttatgatttgaatatagaatatgttagttagaatttataacgtacgccgatttgaatctgccaagggtttccgttcatattggatacacccgtgtttttgtttacgttatatacgtattgcttcttctccgcgtcaaaactcttgatggagtagatattctgcttgcctagattatgtccggcaccccagtccttgttcagcatattcaggaaattgaaaaagtctatcgaggcctcgatggaatgagtcttatagatcttgaagttcttgttcaagcgcaaatcgaaagtaccgtagaagccatttacgccaccgttacgctcggcaaccttcccatagtttttacggatataatcttttacgctcttctccgcttccgggttgtccaagatcgcttggataccctcacgaagatattgaggcgtattactatcgttcgggtcatagatataagccaagtcgttggatgatacgaaatcaccgttcatattaccactaaccgctaaagagtagcgggttccaccgatcccggagaaacgcaagcctacgctgattccccagaaagaaggagccgtaccgtagaatacgaccttatggcggaattggttgtccgagtaagtcatggtactcaaatcacgaggatcatcttttaccatcaaggctagagtcgctgtattcgctacgttaccgttgtaagaggtgttatccttggaatcgttccacgtatagctgaaagaaagctcgccatccttgaaataacgccaagttccatctaccacgaacgcatattggttgatttttccatcgctgattaattccagcacacggcctaccttatcacttttacgtccttgcatccagtcggtagctccgttcttggtattgatactctcggcggggacgaacacgccacgattcccctcggcggcgatacggaagtaaggctcatccaccatattacggtctacgtacatataattatggcgtgcccagttggcgtaagcactgatacctacccgcaagcgatcggagaagaaatgcgtgtagctggcgttcaacttatatactaccggtacacgggcatccttactattcatattgatcgtgctgatcttttggatattcgggttgttgaataaatcaacgcccggagcggtagaaggatctttgcggtatgccgggaaattcggtgtcggaaccaaattgccttgtatatccacggacgctaccttcgtaccgtcgaacagcatattgttgatcatggaatagttgtttaaatccgaaccgaagataccggcgccaaggcggataatatcttgatgtttatcattcacgtcccacgtgaattgaacgcggggttgcaactggaaggtggagattacgttgtccgtacgtaagcctagttcgtcataaacagtctggttaaagttcgcgtggttgaaataacgggtataatccgcacggataccggccatgacctcgaatccggtgaaaagcttcgtttgtaattgtccgtagatagcggagttcaaggtattcatctttacggtaggatcatctaccaaggcgatttcccgggcatagcggtaaggagtcatattctcgaaattatccagtcccgtgaaataaaaccgtccgttcatctcactgccgtagagtgatttcatattggtgtacatgaagtccgctccgaatgtatagttgatgcggtccgtattataatacatattgtctaccaattgaagtacattatccttgaaatgttcgggagcgtagcgttgacctccaagttggatggaagtgtacatgcttttgtcaccagatatagattccacgttctctacgattgctcttgggatattagagcttggcaattgcttgttcggggtcgtggcctcgtaaaccaagaaatgttgaagcttcaactcgttggtcagctttgggcttaataccgagcgtaaggtagcgagtaagctgttgttatgcgatttgcggtcgatccaaacctcgtaaagattgatactggagttatcgctctcgctctgtttattatcctcgttgatgaaattattgcgaatggttaacaagttggttgcgttcaactgccagtcgatacgggcgaagaccgcgttcgtctgcttcttcttaccgaactccccgaattgagggtcatttgagactccgtatttagtacgggcgatatccagataacggtctagcgtagattgagtgacattatagcgagactcgtccgccgccgtcttgatatccgctatataaatcggacgggaatcctgttggtgatcccatacgacatagaagtgcgcacggtctttcacgatcgggcctcccaaagagaaaccatattgataggtagagaagtcggaagtcgatttatttccccgtatatcataggaactggataaccaatcggcacgaccgaatccgaatacacttccggtgaaagtattggttcctgatttcgtgacagcgctcacggtgccgcccccggaacgtccgttggtcacgtcatattgattggttaccacctcaaactcgcggacggcttccatggatatcgtataagcgccggaagtcgttccgctcgctacggttcctttagccgtcataccgtcgatggtgtaattcgttgaggatgataattgcccggcgatatttcctccgctactcaatggcgagagatccatcagggaggtgaagttacggccgtttaccggaagcttcgtgatattttgagcggagatagatgttgccgcgccgatcttcggaaccatgttcttcaaggaattagcgactacctcgacagcttggatctccaccgattcctccgctagcttgaaatccactcgaagcatatccccttggttcaatgcgtatcctgtctttttctgttccccataaccgatataagaagctgtaacggtataaggagaacctagcggaagctgcttgatggtgtattctcctttatcgttcgtgatagagcccgtgaagaatccggtagattcattcttgacttggatcgtggctccgatcactgattcccctttattatccacgaccgtaccggtgataatcgcttgcgttccttgcgcagacaagagagccggcaagcaattaaaaaataacaaacaggcaagcagcctgcatgtaagtttgttaaacatcctcataataatctttttaaaattaaacctaaatatcttttacggcgcaaaagtaagtgtccggttttgcaaagagattacatccgtgtgtaggtttaaataaagaaaaaagcctaatgaaggatatccattaggctcaacgagaaaattataaatgtgtctataaaaaagaaggttagtcctcgtccaaagtcttgataatggtagatgctatcttggatgaactcttgcggctgctctttctgagtttatccgggttctcaagattcatgcaggtaaagaagttattccccctatatacctcatttttatctttgtcgaataaggtatagctgacgatatggaaaagcgtgcgcaagggttggtcttgccatttaagataatgctggtttaatactagcagataatcagcgtcagcattatccaataccttttgtaactcttcggtcggcacggctgaaagatcggaatagcaatcctcgctctccccgttaaccttgatctcattcagtacctgtccggtcacttgtgtagcgtttgccggaataaacttgcaatctccgttctttacggatgcggcgatattctcggcgatgatcgtattatacgtttggtcgatactatccgctttcataccggtctcttcggcgatcatcccattgtagaaatagtttgatttcacgttatcgtgcaaacctacgatgagaatttgctttgcatgataattgtcaccttccttcttactttctttagcgttcgctgctatagaagctacggctaaaaagaacataaccgtaaagattctgattttaaataacctttccatgattcttctattaaattctgtgtctattaatttcggaggcaaagatattagcggggtgttgcagggatattacggttgtataaagtaatagttaccgataatcccccctgtaccggcttggatattaaaatcgtggattcgttgtaaagtctattctaccgtgtggatgagttcaatcaaaaggcggttaccaagaaactttaaggagatatagaaacaagggttgtttttaaggttcaaagaacgctaaaaacaacccctgttatttttacttattattctcgatccacttgcgagcgttcacgaacgcctcgatccatggagtgacctcgtcgttctccttacggtcggcggggtaataaccgcactgccaagggaagatcgcacgttcggggtgaggcatcatggctaaatggcggccgtcctttgagcaaacaccggcaacggaccaaggagaaccgttcgggttggcgggatagccatcgtagttgtatttagcgatgatgttgtactccttctcctcgtaggggaactcgaacttaccttcaccatgagctacccatacacccaacttcgtgccgctcaaggagccgaacattacggagttgtttttcgggatctccaagctaacgaagttagactcgaacttatgggaatcattgtgaaccatcttatgctttttctcgtgctccggataaaccaagcctaactcggccatcaactggcaaccgttacagatacccatgctcaacgtatctttacgtgcgtaatagttgtcgatcgctttcttggctttctcgttatacaagaaaccgccggcccagcccttggcggaacctaatacgtcggagttggagaaaccaccgcagaatacgatgaagtttacatcctccaaagtctcacgtccgctagccaagtccgtcatatggacatccttcacgtcgaaaccagccagatacaaggcgtaagctgtctcacgctcgcattgcgtacccttctcacggattaccgcagccttgatgccgttcggagcgcggcgttcggctgagagtccgtaagaagaaagctttccggtaaagtccttgtggaacttgtactgtacgggctgcatcttatagttctcgaaacggtttccggcacaaacgcttccgctctgctttacatccagtttataagaagattcgtaccatacgtcacgcatatagtcgatgccgaagtgatattggatgccgtctttcgataccaatacatggcgctcgtcggtcggtttggcgatgatggcgaaacctacgccagcttcttccatcaacttttcgaatgccttcttgtcctttacctgaaccaagatacccggattctcggcaaacaggatcttcacgatatcgctctcggagatcttatccaagttgacatccaaaccaccctctacgttggcgaagcacatctctaacagggcggtgatcatacctcccgctgagatatcgtgtccggcaaggatgagtctcttctcgatcgcatcttgtacggcgttgaaagcgtcacggaagtattccggatctttcacggtcggaacctcattacccagcttgttcaaagcttgagcgaaagcggaaccacccaacttcaaggtatcgaaagagaagtctatataataaatgtatgtattcttgtcttgagctactaccggggagacgattttcttgatatcgctaacctctgcacctgcggagataatcaccgtacccggggcgatcaccttatcgtcgccatatttctgcgtcatggataaggagtccttaccggtcgggatattaatacctaagctgcaagcgaagtcggaagcggcttgtacggctgtgtacagacgggcatcctcaccttcgttacggcacggccacatccagttggcacttaaggatacgctctccaacttatctgtcagcggagcgaatacgatattggtcaatgactcggcgattgccataacggaaccggcggccggatcaaccatggctacctggggagcgtgaccgatagaagttgcgataccagctttcccgcggtaatccaacgctacggcacctaagtcgctcaacggcaattgtaattcaccttgacattgctggcgggcgatcttaccggttacggaacggtctactttgtttgttaaccaatccttgcaggctacggcctccaattgaagtacgttctccaaataatggtgaagttcggattctttgtaaacaaccggttgataagattcagtgaccgtatggtctgtcataaccgttctaggcggtttaccgaacatatattccagcttgatatcgataggttttacgccgtccgcttgttcgaagacaaacttcatgtcgttagtagtctcgcctaccacatacatcggggcacgttcacgatccgcgatacgttttacacgggctacatcttcttctttcatcaataagcccatgcgctcttggctctcgtttcctacgatctccttcgctgagagagtcgggtcaccaatcggcaatttgctcatatcgatgtgtccgccggtagcctccaccaactcagacaagcagttgaggtgtccacccgcaccatggtcatggatagagacgatcgggttctcgtcagactcggcgatcgcacggatcacgttagccgcacgtttctgcatttccgggttggcacgctgtacggcgttcaactcgataccgcttgtatattgccccgtgtttacggaagagacggctccaccacccataccgatacggtagttatcgccaccgatcacaaccactttctcgcccggttccggatcgcccttcaaggcatcacgcatatttgcgaaacctacaccgccggcaagcatgattactttgtcgtaagcgtatttcttatcgttctccgtgtgctcgaaagtcaataaagaaccacagataagcggctggccaaatttattaccgaaatcggaagcgccattggaagccttgatcaagatctgctccggagtctggtataaccaaggacgagggtctaggactttctcccattcgcgagcgccttccgtacgagggtaagaggtcatatagaccgctgttcccgctatcggcaaggatgccttaccaccgcccagacggtcacgaatctcaccacctgttccggtagcggcaccgttgaacggctcaacggttgtcgggaagttatgcgtctcggctttcaaggagataaccgtcttgatatcttttacggcgaagaaatcgggtttgtcaccggataggggagcgaattgctctaccgtcggtccttcattgaacgctacgttatctttataagcggaaaccaatttattagggttctcggcggaagttttcttgatcaagttgaacaaggaactttctttttcctcgccgtcgatgatgaatacacctccgaatattttatgtcggcagtgttccgagtttacttgggagaaaccgaacacctcgctatcggtcaacttacgtcccaacttctggcttacctcgttcaagtaagcgatctcctcttggcttagagccaagccctcttgttggttgtacacttccaaatcctcaatgtagacaataggatccggttttttactgatcgtgaagatctcctgattcaagccattgtagatacgttgcaacatcggatcgtgatccgcatcgccagaagaaacaggaaaatattcctcaatacgggaaataccggtcaggcccatgttctgggtaatttcaacggcgttcgtactccacggggtaatcatttcccggcgtggccctacgtaccagccttccaatgtttctgattgaacaggagtcgcctcgctaaacaaccaaaccagtttttgagtgtcttcaggagagaaagcgtgcgcggcctctacagccagcaccgtctttgttgaagattgaaagaatagaatcatatcgttgatttattagtatttatcacgaaataacgaataagcctcttttagagagtgcaaagataatgatttcccgtgaattattatgtcaatacgttttaaaagaaaagagggcggaacctcccggtctcgccctctcatgtcccctgcatagtaaaaaataagagtgtgtctatattctaccagcctgcgttctgttgtgcggctagcgtggggtttcttaatatatcattcaatggaatcggccaaataaagcgtttatccgtgtacgggatgaactgtttgctgttgccgaaccattcagctttcacttctccaccaacaacgaatgcgccttggttcttcacattgttatattcgattttagcgggaataccaccggacggcagcaagtcgtcagccgctaaacgatgaatgtcttcccaacggcgaccttcaccttggaactcaatgcgacgctcccaaaggatagcttccaccagtgctttcgtgttggcgaaatcgcttgccttatacgtctgtgtagcggggtcggccaaagaacggtctcttacttgattcaatttctccaatgcgagagtcttgtctcccgcacgtgcggcagcctcggcctcgtttagcaatacctcggcatagcgcaggatcggggcgtactcttcacgtgtttggggattctggtatttatcacagaagtaataatcgtcagacgcacgataaaggacgaggttacgacgcttgtcatcccctttccagaatttggagttgtaaagggtaggggatgtcgggcacatcgcacggccaccttcacgggcagacatcatagcggacatagctccatttacagatgcgttatcttgagagtcattcggaatggagaatatagattcctgattgtctttgtaagaaacgaaaggagtggcaggattggtttccagaatgaaacgtccgccttccagtttcttagcttcagtaactacattgttccaatcacgcatatgtaaatatacgcgcgttttcaatgcgatggcggcacctttgctcgcacgtccgatcttatcagcatcaataatgtccggaagcatgctttccgcattattcaggtcgcttaatatctgatcgtaagtctccttaacggtagaacggcctatgctttgttgctcagcgagttggctggggtcgtttacggctttcgtgtaaataggcataccgtagttattgttaccttctacgttgtagggcagggcataatggatcatcaagttgtgataggttaacgcacgtaagaacaggcattctcctttgtactgattccctttctcttcggttatgacactcgccgctaccgcgccttctatacctgcgtataccgtattatagcggttaatagcctcgaaagaggtttcccacatcgccacgttattagcggtagtcaagttataggttgcggaataggtataatcatagaattgggcggttaggttcatatcttcaccgcgcatttcgccttgcaatatactggccgctccaaaaggataaccgcgtgcccacccaaagtcattcggatctacgtacataccacattgtgcggcatcgtaagctccgactacggctaactcgcaacgttcttctgtcccgtatgccgtaagctcggagaatttgtcaacaggttcaaggtctacgacgtcgctttcgcaggcggtgaacacgggtagcgagaacagggctgtccctaacgctactactgaaatgtttttatataattttttgtataacataattgtaacttttcttagtttgtgaaattagaatgtaatgttcgctccaaaagtgaatgaacgttgctgtggcataccgttccaatctacacctaaacgagagtttgtctcaggatccaatccggaataacctgtgatagtgagtaagttctgtccttgaacatagaaacgaatctttgtcatgttcagtttggatacgaccgccttcggtagtgtatagcctaaagctaacgtcgatagttttaggtaattgccgctctcaacgaagtgtgaatccgtatatccatcattgaataaggaagaggcgtctccataaccgatttttggagtcatgccgtcacccggttgctctggagaaatccagcggcctaagatttctgttccattgttggagaaatccatattgaacaatgcgctttgacgagaagcgttcatgatcttattacctccggagaagcggaagaatacatttaaatcgaaattcttgtaagaaactgtattattccaacctccgtaccaagtaggcatagatgaacctaataccttacggtcgctagcgtccaaggaagaagccttggagacatccgaagggttggaaggatcatattccgcatagtcgtaagagccgaatgtgtcgaattgcactaatgaaccgtccgccttactccagatcggattaccgtttgcggcgtttacgccgtaataatcatatccatataaagatctatatgactctccttcacgaatgattgtgtaattgtctacgatgtctgttccgccgtataagctcttcaccgtgttcttagctgtggagaagttgaaattagtttgccagttccaatctttggtagcgatgattgtagcgttaactgtcaattccataccggagttcttgatcttaccgatattatcaaaatatgagttgtaaggaataccagcggtaggtgctgtaggaacttccaacaccaagtctttggagttcttttgccaataagctagctcgaatgtcaggcggttattaaagaaagagccatccaatccgatatcgaaagtctcggttgtttcccatttaagctggctgttacccatacggttccaagcgatagctgtattcgatcctgctttcttcgccccgtaagttcccagataagggaaataattccctaggtcagagtttccgattgtagcgtagctggcacggatacgtaagtcgttaaaccaatcattaatagttgattcgctccagaatttttcgcgagagatacgccaagcggctgatcctccccagaatgtaccccagcgggtgtctttcggaaggctggataagccgtctgtgcggacggaggctccgatataatatttactatcatagttgtaattcgcacggaacatataggaggctaatcccataaacgttttacctccagatacgaatctctcaccaaatgtgttggaaatgatatggtcggtgaagaaagcatcggatatttgttgcacggttgcgtccgtatattcatattcttgatgggtgtactcttgtaccgctgtcgccgtcagattatgtacatcattgaatgtacggttaaagttgattacgttttgccagttccagttcgtgtatgtggtattgatttcttccaataagccgccatagccgtatccgtctcctgattccgggttccataccatgaaatctttaacattcgagatgtctaagccagcttgtgtctttaaagtcaatccgtccatgaatgtgatttcagcccatccaccacctaatacacgggtattggtcgtacggtttacgttattgtctaatgcccagacgatattctggataccattatcaatataggaaaggttgcttccgcgacctaatgtcttacggttttcagcgtcgatattgtaaccagtaggatcatccggattgaatacagatacgtttggaagcatacgagtgccggcgaaacctacgccacccaatgaattctcgtcattcatgacaccattaacccgggtacgggtcatctggccatttaatccgatgcgtaaccattttgtcgcttgttgtgtcaaatctgcctttaagctcaaacggtttaagtcattggcgcgaatgataccttcttgttccgtgaaacctaatgatacataatattggcttttatccgtaccaccactggcggataagctatgattgtgctggaaacctgtacggaaaatataatcattccagtttgtgtccggtccgttcggatcgtaaacagcctgtcctttcattccccagttctcgtatttctcgttagcgatagtcacgaaatctttcgctcccagaagatcatgcaatttagctgcgctggctgcgcttacatagccatcgtaagttacttgagtacgtcccttggagccttttttagttgtgatcaatacaactccatttgccgcacgggagccatagatagctgtagccgcaccgtctttcaatatttcaatggattcgatgtcattcgggttaatatcagacatcgcattgtaagaagcgtaagccattcctaagccggtttttccatcggcgttatcaccggtggcgatcggcatgccatctacgatgaataacggctgagagttagaactgatcgtactcataccacggatcttgaattgaggaccgcttcccaatacgccactaggagtcgtaacctgtacaccagcggcacgtccagctaattgagagtcgaaagacgctgttgccaagttgcttaagtcttcacctcctactttagatatggcactcgtcacatccttttttctttgagttccgtaaccgacaaccacgacttcatccaagttctgagagtcggactccatcgtgactttaatgattggttttactgccacttccacagatttcataccgatgtaggaaacgattagctttttcgcgttagaaggaacatccaaggtgaacgctccgttgtaatccgttacagtaccggtagtagtaccagctactacgatagaggctccaatgataggtccatcgtcttccgccgagataaccgtaccggtcaccttcgtggtctgagccgttgcgaacgctatacttgcgaacaagcatagtaatagataagttaaccttttcatagacacatactttttgtttaatttgttaataaatagatcgttgtaatcaattgttgccacttagtcgattgacttagtttccgaagaacttcatgagggtaaggtactttggtgttacttcctagcattgatgcgggattgagttaaaaataatttgcatattaatactatatattaatactagaatgtattaaattaacatataacttaaaataatccgtattgacaaagttccgtgtaagtttatttttattgtcaatatgtttgtttattgcaaatatatctttatatttgccgtacagccattaaaataaaatgcttgctgtaaatagtacaattagacataacagatgtttacataggttgcatgttctataatttattaagatatttataataattaataaatattgaacggaaaagtgatttagttcttcggagactaaggtgtttcataaatactatctaatgtatttaaataaaaaaagagtatctaataaagatactctttagatatatgtgaatagagtgacctattttgatttttataggcttttcggaggatataatgcgtcccaccactccggttgatctttcaaccacttagcgaaccatgcgtaaattgtgttattccacaagatacgtttctcataatccagtatatggtggttctctccttctacctggacaaacgctgtaggcttacccaataattttaatgcggtaaacatctggatgctctctccaatcggaacattcgtgtctgcggttccatgtaagaacaagatcggggtattgatcttgtctgcgttaaacagcggactttgtaaagtgtacatatcccgggcattccatggataactgttagcgctagccaacgagctgtatgaatatccccagtaaccttctccccaatagctggtgatgtcgctgattcccgcatgagacatggccgccgcgaatatatctgtttttgtttgtaggtattgagtcatgaaacctccgtatgaagcccccatgcaaccgattttcttcgtgttgacaaaaggatgctcctcacagaactttttcgtgccttcgatgatctcgtcagcggtaagtttaccccatgcgttgacatggcgtgcggagaactcttggccgaatccagtcgctccactgggctgtatgatgtagacgatgtaccctaagccggcgtatacatgcgaaggataacggctttccatcacccgggccgtaggagttgttcctccgtaataattcacgatcatcggatatttcttagttgcgtcaaaatgaggagggagatagaagcggccgtaaatcgtatccccttgggcggaaacgaaattccaatcttgcacttctcctaaagtgacgtctctcaagatctctttggagagatcgatcaagcaggaagaggcgtcgtttttcaggttataggtataaagcctttgggaattggaagcgcttaatccgaaataaaccatttcgaaagcttgattggcgatggagtaatcggagatgacatcttccttggcttgaagttgcttaatctttccgttggacgggtttagactatacatgcgaacacggtccttatctttcgccgtgatatagatttgtttatcgagggcgttccactcgtaggaatcgacagaggggtcaaaatctttcgtaagcggctttatacttttatctgctatattgtataggaataattgcccgtcactcgtattcgatgtctgtccttctttgatctttaatccgataccatcgaaagcctctccagacgcgtcaacgagtaattgggtggcatccggggagaaaacggcacggcttacgaatttctcaccttttataagggtatccacatgcatggttcgtagatccatcttatatatatatgtacgtgagaaagggcgctccgttaaattcggttccctgcgactgaatagcagatagtggccgtcttgagatacatcgttgatgtaagtagaagtatgtccataggtgagccgttggaacaatccggttcgcaggtcatatttatggataaacatacggtttctccatcccggttggcgatcatccggcaccagtatctcttggatctcttttcgttcttgcggtcctttctcccgtatggagaataatagatagtcttcggtaggcccgaagctgaaagaaccttcaggcaattggctggaaaggatgttctcctttttactggtagggtctaaggtcaccaattccgtgcctttcatccctttccgggtgtaataggccagattgcttttaggcatccagcgtaagctctgtccgttctcaactaatacggaaccggtagccttgtctagtatctgggtaaatgaggactgctttccgccgggataggtttcttgataggagacgataatgaattttccattcggggacaggctggcggattggatgcgtttaccatcaaatacatcacttaatgtataacgtttctccggattgacggtcgcggttaccaccgcgtctttttccgggttgaatgaggcttttaaggcattctctttgtggctctcagataaatatttaattacgatttcatagcgtcgcggctccaaggtcaacgaggcttctccttgggttagttttgtgagttgtccatccacgtagacttctgaaatctcagggccattgatccttaaggtgccttttgtatagcggtcactattcaggtagaaggaaaccaaatgtagcgcgtaggaagaggccgaggttggcaaggtcagctctccggaagacgccgcgtcaagggtttgtccgctttgggaaaggttgcagaaaggaacggtcgtgttcaatagttccttgtctgagaatctcttactgtttacatccaggctatctgccaagaagggtttcttcacctcgtaagggccggcgtaattataatgtcgcacgacaacctcatccgcccatagtgagcaacaggagcatagggctgaaagaattaagatgtttttgtttatcatgatatttgttatttagtataagataagaaagcgagatggcaggtatctctcagccatctcgctgtatcattatcttataagatttctatctcatctacgaacaagaatgcgggacttccggcgccaccgtgccattttggtagtttgctgctgttgatgataacctcgacatagcgggcctttaccggggcgaaggatatctcttggggatataatccgtccttgtcgttttgggttagctccgggattttcttggaagctacttccttgaaattcttgccatcgtcggatacctttacggttacggcggaggctcccatgatccaatcgcctttcaccacgtttgtgttgaaagataccttttggatttcggttggttcctttagatcgatcgtggcgtcaaggtcttttccttggaaacccagccaatggccggtcttgtaattactacctccacgtaagccgtctaccaatacctgtgccccgttgaaaacgtatcctttgctgggttgctctttcaaggtgatgggcttcatcgtcgctttattgaagaagatatcttctgagaagatgcggctcgtaccgttcggacggacaacgatcgccttgaattcgcaatcttggttgatctgtaccgggccttcatacttgatgctggcgatcgtaggatcgctaccgtctaccgtataatagatatctccttcacccaacttcgtcaaggctatgtcgagtgttccgttctccgtattggtggtcagggaggcgttaatatcgaagatatgctttccgtaattatatcccaagcgatcgtaaagttgtgtcatgcgggccacacggggcaggaacgtctgataatctttcttggacggatcgctccactggatatcggctacggcatcgatacggggcatgatcatgtattctacctgtgagaaggtcgggatatattccgtccagaggttggcttgcgccccgatcacgtacttctggtcttcaggagagataccggctgtcggctcaaaagaatatactttctctaacggcaagtaaccaccgatagcttcgggctcaagatccgtatccgctgattgatagtaatccagatatacatatgtattcggtgtcatgaccacgttatgcttttgcttggcggcctcgatacctccatccatgcctctccagctcattaccgtggcattcggggccaagcctccttctaggatctcgtcccagccgatgatatggcgtcctttgctctccacgaatttctccatgcgggagatcacgtagctttgcaaatactcctcggcggaatgcttcttatctcccttgataccttccgccttgatgcgagcttggcattttgggcatttctcccaacgtaccttcgggcactcatcaccacctacatggatatattcggacgggaaaagatcgatgacctcgctcaatacgtcttctaggaattgcatggatttctcgtttccggcgcagatcacgtcgtcggctactccccattgaccccatacgtcataagggcccccggtgcatcccagttccgggtaagtagccaaggctgccaattgatgtcccggcatatcgatttccgggatgatcgtgatatggcgttcagcggcatagttgatgacatcgcgaatctggtcttgtgtatagaagcccccgtattcttttccgtcatatgttccggagttatggccgatcacggtttccttacgtttagatccgatctgtgtcaattccggatatttcttgatctcgatacgccaaccttggtcatcggacagatgccagtggaacgtattttggttgtgcaaggcaaggatatcgagatacgtttttaccgaatccaccgggaagaaatggcggctgacatccagcatcatgcctctataggcaaaacggggatagtcgttgatggtagctgccggtaattctacgttcatcccttgggccgtggccgggatcgatttacgtaatgtctggataccataaaatacgccggcatccgtgcttccggcgatccgtatcccgttatcgctaacggtcagttgatatccttccggattctggatgctttggtcgataacgaggctgatccccttaccgggctggccggtagcggttgctaattcatagcccgtgatttccttgatataagaagcgaggaactcggcgttcttcttcatcttatcattgccctccggataaaatatcttcgtggatggacttaggacgaaaggatttccgttcgtcaatgttacttcttgtagcaaaggcactactccgtaatctccttttacggccttaccaccggagcaagcgatcattcccgtgcaaaatgtcaggacgagcgctagtttgcttaggctgttcatgtgtttagagtttagaacgtaaaacaataattgattcagtatcaccgcccaaagataaaaagaattagccgttttatctaatgcttttacacttttgatgcgataaccttagggactttgtctatatatagagactatttatcaactggtgcatgatcatccaacagttggtggacgatcatgcaacggctgttggatgatgaatacttctataagaaatgtctaaggaatatggaagaaacacctaagctctaaagggaaaagggccagggactaagggaaaagaaacgtcttcttgagaggtatttccttgtccttcttataatatgtattcacacgttttacggttgtgcagcggatgtaagcgtcatggcagtagatgagcgcttgccttttttcggcggcttcggcaagcatgcgcagtttctcgttgtatgacgtgaccggatacgtgtcgtaagcggagatccattccggggatacgctggctacaagggggataacatctccggcaaagacaaaagtccgatcttccgtatggatatagggaacaatttgccccggagtgtgcccatcatacaagcgtagctctatcgtggggcaaatcgaagtgtcggcatctagcagccgtaaggaattagcatccgcgacggcttgcatattctcgataaaataggaatctttctccaaggcgttcggatgaaggaaattctcccattgcttgcggctaacccagtggttcgcatttgggaatgagagaaataaatgtccggtagattcatccttttgcgtggtataaccgcaatgatcgaaatggagatgggtgaggacaacatccgtgatttcctccggttgaattccccggtttcgtagttccgtgccgaggtctaccaagttgaagaagcggtaataacttagttgttttaagtgtttatttcccgctccgttatctactaggacgatgcgtccgtcatctgtttttatgacaaggctacgcatggctagcacgcaaccatttgtctcgtcgctcggatagcgacggctccaagcgcttttaggaatggccccgaacatggcgcctccgtcggcgtagaagtagccggtatcgatgatttgtagtttcatggtttctgcattctttctttgggggagtaaaggtatggtttttatcatactcaatagtataataaatgtaaaaatgactggtttaaacgttcgtttagactagtcgtccgcgaagttaaccattaatttaaattaagcaacattcatttaaatcatttttcgattctattagtaataagacttataatcaatacattacatccaatattaaaattgtgtcaaatgcactatcccatccatcaaaatgactagtctaaaccaacgttttagctagtcatttttattagggactgcgctcagagatagcagaaagtaggtttttggtgtttgaatattgttaatctcaattaattataaccatttaataataaagatggaaaaatgtagtaagaagagcaagcaattgtgtttaagcttgttcaaaccaagtgttatgatgcttaccacgggattcctatgtatggcctcctttcaaggattggcggctgtggaaccctcgcacaactacggaccgaatgttgaatcggtcatgcaaaatggtaagactgttacggttaaggtttcagattcaatgggtgagttgatcggcgcgaacgtgttggtcaagggaactactatcggtaacgtaaccgacatgaacggctcggttacgttgcaagatgtgcccgcaaacgctgttttggaaatctcttatatcggttacacgaccaaggaagtcccggttggcagtcaaagtgttataaatgttacgttgtcggaagattcccaggctcttgaagaggtcgtggtcgtaggttacggtacgatggagaagaagcaagtgaccagctccgttacctcattgtctgccggcgatatgatgaagggtgtgggtggtgccgatatcaccagctctttgcaaggtaagatcagcggtttgatcttgcaaaataatggtagtgccaatggtacgaccacgatccagttgcgtggtttgacctctatcaactctggtaaggctccattgatcgttgtcgatggtttcccgggaggtgatattcgtgccttgaaccaagacgatatcaaatctatcgatgtgctgaaagatgcttccgctggtgcgatctatggtacacgtgctgcttcgggtgtgatcttgatcacaacgaagagtggttctaacacgaatggtaaagtaaaattgaattatagtactgagctttcgaagaaacaaaactatggccgtccagatatgatgaccgccgatgagtatcgtaatcgtacggacgtgaatatcattgattacgggcagaacgctgattggtgggacgctcttttgcagaaggataacttctcgcaaaaacatcacctctctttggagctaggtaccgagaacgcacaagtgtacacctctttcttctatgagaccaacgaaggcatcacgattaaggataaccgtaaggactatggtggacgcttgaatgcaaactttaagctgttcgatggttggttagagatccgtccgatcgtggattatcgtcagactgctcgtacttccgatggatcggatgaggataagaaggcaaacttcaagcaggcgttgtataataacccgactcgttccccatttgacccggaaagcccgagcggatataacgtatggaccggagaaactttggactacaatatcgtagcggatcgtatgctttccgactacgagggcttggataaatggtttaagcctgaggtgacgatgaaattgaacatcaagccgattgaaggtttgagctattctcagacattgggttacgagaaccgtcagtgggagttgcaccagttccgttctcgctatcaccgagaggaggtgacaaacaaccgcggtggttgggcgaaattggaattctcgaagaccgaacatcttacttctgagggttacttcacttacctgaaagaatttaagggaggtcatagcttaaatgccgttgccggttactcttatttcgagaagaatggagagaatttcaatgcggagaactatgatttcggtgtagaaggcctgaagtattgggacttggaatccggatcttatttgaccgacggtaaggcaaagatgggatctaaaaaagatattacggaacgtttgttcgctctttatgcccgtgccaattattcatataatgataaatatatggtaacggctacgatccgccatgagggttcctcgaagtttgccgcagagaaccgttggggtaatttctgggcgttgtctggaggttggcgtgtatctggtgaggaattcatgaaagagtttgattgggtaaatgacttgaagatccgtttcggttatggtgtgaccggtaataacgacttcgatgcttcctatatggctaatacgttaagtcgcgaccaatattggatgcttccgagtggtagctgggcgtttgtttatggaccgagctctaacgtgaacccttatttgggatgggaagagaagaaagagtggaatatcggtgtggattactcattctttggcaaccgtatgtatggtaagttcgattactatcgtcgtaagatcgatggcatgatctacgaggtgaatgttccacagccaccgtatccaaatggcaaacaatggcagaacattggcgagatggagagtaaaggatgggagttcgaggttggtggtgacatcatccagaataaggacttcacttggacttccagcttgaatatgagccataactcaggtaagatccttacgatgtatggtaacaattcacgtatggatggtaacgctatggatgaaccgggatggccgggcgatgcctctcgtattgaagagggggcagagatcggtgcgttccatatgtggaaattcgctggattcgacgataaaggagacttccttttgtacaataaggatggtgaggttatacctgcttcccaaaagagtgtagacgacaaacaatatatcggtaattatctacctaaggtgatgatgggatggaacaatacctttacctataagaattttgacttgggtattaatatgcgtagttggataggtttcgatgtcttgaatacttatccgatgtacttgggtatccagggacagagtggtgccggccagtggaatctttggaaaccggcgcttgacgatccgaagtataaggacattcgcggcgtgaagctgctttgtgactacttcttggaggatggctcgttcttgaaaattgatgcgattacgttaggttatacattggcgttgagtaagtatacaaaatgggcagagcgcctgcgtgtatatggaactgtcggcaatgtagcgactattacaggatatagcggacataatccggaagtgaatattaccggttgggaaggcggtgtcgataaggtttggaactgtgatccgatagttcgcacctatacgttaggtattcaagtaacattctaaaaaggtaagaagaaaatgaaaattagcaagataacaaattggttggtagccggagctgcttgcttgctgctgggtacctcttgtgacgtggatcctacgttctattcgcaggttgttcccgacacgtattatacgaatgcagacgcggtttggtcgcgttttaatcgtccttttacgcattggcgttggtgggtagctcataacgacgctcgtgtgcgcttgatggaagtgggaactgatgctatgtgtgtgcctactcgtggtaatgactggtttgatggcgccgtttatcagaacatgcatcatcatcattttatggatgatatgagcccgatgaaggatggatgggacttgacgacgatgggtgtggctcagtcgtggagtgccttggaggatttggagaatattgatttcgtatcggtgggtttgactgaggaggatcgtgtatcaatgattaatcagttgaacgtattggctgcctctttttatttggatggtttggacatgtttggtggtatgcctctttacacatctacgaaggaggatgtgaaggctcgtgctacagatgtggagactttccattttatcgactccttgttggatgtatctatgccgaatcttccgttgaaggagaccttgggagcacccgagacgaacgttatccatcgtgctgtggctgcggctttgaaggttcgtttgtatttcaacgctgaatcgtatatcaataaaccgatgtatgaggaggccgctaagatttgtcaggatattatcgatggaaagtatggtcagtataaattggccaaccatttcaccgagatatttggttggggtaatgagacttgcccggagattatctggacagtaccttccgagaatgccaaaggtgagacggatggtggtttgactgccttcactcttccctataatttcaaggatttcttagggggcttgcaggatgctagtggtaataatgggctttgcctatgccctagtcgcgatccggagggtaacttgtataagtttaacgtaggtaatccatacgagacattcaacgacaaggatatccgtaagcagcagtatgtatatgagggtggtcgcaaataccgtggtctgtttatcgttggtgagttgcaaaacccggatttccccgagtataaatgtctgggtgcccgcgagtatgccggcaaggtcttgaatgtcgtagaccagatcgctcatatcagccaggtgggcaatacggtagccagtcttaaggatctgacttctacgattgccgatgcagaggagaactcaggcgtgcgtgttcttaaatttagtcctctgcctaatcaagatgagttcaaggaacgtttcaacccagattgtcctgtaattcgtctgacagagatctattatactttggcggaatgtaagatgcgtttgggcgataagaatggtgcggccgatatcatcaactccatccgtaagcgtaacttcgagggtggaaacgacccggatcctgttaccgctgccaatttggataaataccgtatgctgaaggaatggatgcaagagttcttgcgcgaggcccgtcgtcgtacggacttgatccgttgggacgcatatgtgacagaggattggtgggatcataaggctacgaacgatgagaaatacaatcgttatccattgcatcaattgtcattgggtgcgaacccgttgttggaacagaacccgggatattaataagttagacttaatataaaaaaggaggtatgttgcagaggcatacctcctttttctgatatggcgtggaaaacgcagtagtacttacttgactggagaatatgtacttcatcgggcaaataagtatatattcgtagacgaagtaagtactactgcgttttccggcatataattttgattgatttataacgtgatgaaacaacaattaattagcttgtttttttgcggtgtattattattgcaaggttgtaccgaaaagaaaaatgaggcacaactagagaagactctatctgtctatcaagtagatttgaagtcggaatcacccaaagaaagtattgatcgatttctggccggtatggagatccggttgttacctttggagtcgggagacagtatcctgtttaaaggctccgcctctaccatccatttggcagatgatgatatattccttttagatgcttctcagcgtgtgattttccgtttcggcagggatggtaagttcaagaacaatatctttcggaacgggcaaggcccggaggaatataacgtgctattcaatatggctttgtttgacaataaggtttatgctttggataatacgaagatccagctgtatgactatgagggtaattatctcaaaactgttcccctgaaaaatgatggtcgtcaggtagctgtcgctaaagatggcacgatagctgtcgcttccaattatatccagccttatcagctaaccctatatcgtccggatggtacgatctccgaatatttacctagcgataagaacttattgaaacagcaaatctctcagtccacctatcattcgttgaagagatatggcgatcggatcttgttgacaaattattttgatccatccatctatcagctggaagataccgtgtctgccttcgccacgcttgacttcaaaggcatgaatatcccctccgatatgtttagtggtacggatgaggagatcgccaaccggttccgtgaataccgcgagggagataaggccattctctcattcgatcgcttgaccgttacggacgactgggttgtgtttgcgccttctttgatctgggatccatgtgtggtttattataaccgtaagtcggatacttatcttctgaataagaactgggggcaaccttacgatttgttcttcggaggctacagggcaccggacggatatgatgagaagagccgggagttttaccaactggtcaatgccgtagagctgaaagaggtcgtaggggaaatcgccaaagcggccccgaattatcaagatacctatccgtttttgaagggtgtggatgtatcccaaatagatgataatacgaatgattggattgtattctttaagttacggtcttagaggatatataacttgtatgggagaatatgaccgatctctgtattatcttcaacgatgtgatctgctattagttcttattcaaaatgggaggaattgcgtttgatcaagcgttttttcctgccagtcaagcgtattgtcaaggaaagtttttgagatcatatgttcttatcttgttccgataaaaaggaatgtctatctttgttcatggtaagtatatctaaacgatcatcgctatgaaccagacaatttatcctatcggcatacagaacttcgagaagatccgtaaagacggttatctctatattgataagacagctttgatttatcagttggttaagaccggaagttactatttcttgagtcgtccgcggcgtttcggcaagagtctcttgctatctacgttggaggcctatttccaaggaaagagggagctgttcgaggggttggcgatggaacggttggagaaagactgggaggtatatccgatcttgcatttggacttgaatgctcgtcattataaagatactgccgctctgactagtatcttgaatgagttcttggagaaatgggaggctttatatggaacggagaaacaggatcgtgccttggaggaacgtttcagttatgtgatagaacaggcttatcgccagaccgggcatcgcgtggtgatattgattgacgagtatgacaagcccttattgcagaacctgcacgatgaggatatgcaggatcagttgcagaacatgttgaagcctttttacggcgtgttgaagacgatggatggagccatccgtttcgccttgctgactggggtgacgaagtttggaaaggtaagcgtgtttagcgatttgaataacctcatggacatatcgatggacgatcgttacgtggagatatgtggcatcacggagaaagagatacatacttgtctggaagatgaggtgagggaactggccggagcgcaagatatgacctacgaggagacctgcctgagactcaaagaatgctatgatggataccatttcgtggagaattccatcggtatgtataatcctttcagcctgctgaatacgttcgctcgccggaaattcggcgattattggttcgagaccggtaggccctcttaccttgttgaattactcaagcatacccattacgacctttatgagatggcgaacacggagaccgatgtggatgtgttgaacagtattgactctgcctcgataaatcccgtccccgtgatctaccagagtggctacttgacgatcaaggattacgatcctgaatttggtatctaccggctaggtttcccgaaccgggaagtggaagagggtttcgtgaaatatctccttccattttacacgagtgttagtgcgcccaagacccctttcgagatcgggcaattcgtacgagagatacgctccggtgattacgatgcgttcttccgccgcttgcaaagcttcttcgctgatacaccctatgaggtgatcgccggtcagaagccggagcgtgatacggagttgcattaccggaacgtgctttttatcgtatttaagttggttggactttatacgcaggtggaatatcatacctcacaagggcgtattgatctcgttttaaagaccgatcgctatatctacgtgatggaattcaagctgaacggcaccgccgaggaggcgttgcgccagattgaggagagacagtatgcgcttccctttgcgagtgatccgcggcaagtttttaagatcggcgtgaacttctcctctgtgacccgtaacatcgagcgatggttggtggaataataatctattaagtatatgaactggaaacaaacgcttttctggtctttttcgacagttgctattttttattatttcctgctttttggcgtgtttgtgtttgtcggtcaggaggagatgcaattgtttatacctgagtggtggtatatccgggagttcctttttcagccgggaggattttgcgctgtcgccgggcaatggatcattcaatactaccggcagcctatgtcggcggtggttctccatacggttttactcgttggttgcgggtttatggtctataggatcttgcgttgtttttctgacaagacctacctgctgttcctttctttattgccggtcctgtatctggttaagatgagtattcatggggagtatttggtggacgggacggttggcgtggttttgatgcttttagctttgtcggtctcgctaaaggtgcggcgggcgggttctattgccggatacggaattgcctctacactttttttatgtgggctgactgggcttctttcggtttgttacgctttcttatatacgctgttagctttactccgctacaaaacgtcgcggcaaagattggccgccgctgcctgcttgatcccagcactttttatatatttgtttagcggatggttagggattcctgtacctttgtctgatggatggatgccggaagcctatctggagatacagcgattacctcattattatatgtatcgtgtatggactttctttaccctttcgattgtcggtgttgctttattcgctcgctttgttccggtgattggcgagaagagtaaatggatggatcgggtagcccttgttgtttgtctgatcacggcgctggtatccatacggttttgcctgccggaaccttggcatgcgcaacgcatgatgcttgacgagctctctttcttagcccgggagaggcaatgggacgctattattgataagtaccggggaaagcagatctataattatgctagcttaaactatttgaatatgtcgttggcccataagggagaattggccgaccggatgtttactttcgatcagaaaggaacgaaaagcttatgtgccgattggaatcagaccttttacatggatcgtttattgagcgatgttcattttcttattggcgatgtctctttgtctgaaagtcttgcgatggacggatttacgcaagccaaacgtaaagggagtgcccgcatgatgcaacgtttcgtgcaagtttgtctgattaggggtgaggtggcgctggccaagaaatatttggacttgcttgccgctatgccattctataaagattgggcttgccgttatgctacctatctggtacatccggaattaatggataaagatccggagttgagtgacaaatatatgcctgttgagaaaagggatcgactgagtttgtccgtacctgtcgattccttatggagtggatacaatcttccggatcatcggatcggttgggaataccggggatgttattatttgttgggtaagaagctggatgcatttggccgattcttggaagaaacacctttcatgaagggggaaccgataccccggcatttccaagaagccggattgttgttggcggacaaagacagtatatcgctttcctcctattccatacagccggagatcgtagaccgataccgggaattcaagcaggttttgggacgatctgccaaccaagtggatgtgtcctcgatatatcgacaatttggagatacctattggtattatttctatttcaagatctttaaaggagaagaacaatgaagcgattatctatctgttggattataggttgtcttttggaacttgtagcttgtaggccggaagttcctacgcaagcggaacaaggagaaactgacgtgtttccggattacagggaagttactgtaccggtcaatatggcccctcccaatttcaagttggttgatcaacagctacaggggataattcggttgaaaactatgaatggggagttgataatcgcagccgatcatggtgttttcaacctgccggaaacggattggaaggtcttatcgcaggacgcacaaggaaaacaaatagatgtgacggtttattttcgagaacctcaaagtgattggaaacaaatgagtttccctatctatgtgtcaagagattccgttgacgcttatttggtgtatcgccgtatttttcccggatatcggatgtggaacgagatggggatttatcaacgatgtgttgaaaactatgttgaaaagtctattcttgataaccaatcgacaaataatagttgtatgaactgccatgccttttgtgagcgacaaggggaacaaatgctttttcatcagcggggttctcataatgggacttacttgattgatcatcggcaggtaaagaagattgcgttggaacgggacggtaagccggcttcgttcgtttatccgtattggcatccatccggccggtatgttgctttttctaccaatgagacccaccaggacttccatctttccgatgagaatcggattgaggtatatgacgtggaatcggacgtgctgatctatgacacggagaaggagagggtattcagttcgccattattggcttctatggcgtgttatgagacttttcccacttttactccggatggcaactatctgctgttctgttcggcggattctgtctgtatgccagaaaattatcgggatgtccggtataacctgttacgagtcgcttttgatccgaaagacggttcgattggaacccaagtggataccttatataatgcgagagaagcgggccggagtgttaagttcccgagagtctccccggatgggaagcggctactttatacggtgtccgattatggcaatttctctatttggcataaggatgcggatttgcatatgctggatctgtctaccggggcaatcgattctttgccggaagtgaatagcccggatgtagagagctatcattcttggagcggcaatagtcgttggtttgtcttttccagccggcggggcgatgggcttttcacacgtccgtatttggtgcatgtggatgagcgggggcagtgcggcaagcccttcttgttaccgcaagcgtctccggattattatgagcgttccctgttctcttttaatgtcccggaatttatacggactccggttctaatctcgaaggaaaggctggtcgaggcctcgggaaaagaagaggtcacgaccattaaacgtatcgagggcatctaatttttcgcttctttgtgccgaaggtatttataaaagtcgtacttttgcgctaaaatcaaaacgatgcgaaaagttcatttgatctccgtaaccgaacctttggttttagatctagccctagcacttcgagaaaaaggatatgaggtaagcgcttccggttgtggtctgactgaagagatgataggaagacttcataacgcaggctgtacctgttatggggatgggtggtttccggagaaattaataaaagatattcactcggtggttttgggtgctaaagtaaagcaagataacccggaattattgcgtgcgaaggaattggggatgttaatccaatccattccggaatttatatttcaacggactcggtcgaaaactcgggttgttgtggcgggtagtcgtggaaagaagacaattatttccatgatggtctgtgcgttgcgccggcaaaagttggcgttcgactatgcgttgactagcaaggtggactcgcttccgaaccggatacatttgagttatgaggcacgtatcgctttgatcgaaggagatgagcatatcacctctgccttggacaagcgtttccaattggaattctatcgtccgcatatcgccatcctgacgaatttatcttggtctaccgagacggatcatgcgactccggaggcctatttatccacttatcaatctttctccgtttctattgagcgggaagggaaattgatttattttggaggtgatgatactgtcagtcagttggcaggggacgtccggagcgatatcaccgctatcccttttgaggaacatccggtcgtggagaaagacgggcagacttttctgcatactcgctacggagactatccggtgcggattcccaatcgctatttcttgatcaatctgaatgcggcacgtttggcttgccggcagttaggcgttaaagacgcggatttttatcaagcgttatcggaatatagtttatctttgccgatatgataatagctagacaaaaaagaaaagagaatatcgctgaatatctgctttatatgtggcaggttgaggacttgatccgggcgaataagttcgatatggattcgatcaaccgcacggtgatcgcccattacgaccagcccgaggaggtgaagaaggaaatcgctcaatggtacgaggaattgatcgagatgatgcgtagcgaaggggtgatggagaaaggtcatatccaattgaacaagaatgtgattattactttgaccgatttgcatcttcgtcttttgaaatctccgaaagagatggtttatagcgcagcttattataagacgcttccttatatcgtacagctccgggctaaatcgggtggagaggatctgccggagctagaaacttgtttcgccgccgtatatggctatctgcttttgcgtatgcaagggaaagaggtgagtgcggagacgttagagggtattaaacaaatcagttccttcttggcgttgctcgccgagaaatatcgggaagatatgaaaggggaacttaaactagaggattaataatagatatagacatgaagacagttttggtaaccggagcgaacggtcaattgggaaattctatccacgctcgtatcagccagtatcccggctataattttctttttacggatatagatacgttggatatttgcgacaaggaggccgtccggaaatatgtcttggaaaatgatgttcaatatgtcatgaattgcgccgcttatacggcggtggataaagcggaggagcatgaggatctgtgtatgcgcatcaaccgggatgcggtacggaacttaggtgaggccgctcatgccgtgggtgcgaaggtgattcatgtatctaccgattatgtgttcgatggaacgagttgccgtccttatctggaaagcgatgcgacttgtcctgtttccgtatatggacgtacgaaactggcgggagagcaggccttgatggaggtgtgtccggattccgtgattatccgtacggcttggttgtattccgagtatggaaacaattttatgaagacggtattgcgtttgggaaaggagcgggatgagttgcgtttcatattcgaccaagtgggtacgcctacttatgccggagatttagcggtcgctatgcttgccgtgctggaacgtgccgaggcgggtaaatttataccgggtatctatcatttctcggacgagggggtgtgtagctggtatgattttacggtaaagatcttgcaaatagcaggtatgaataaccgggtgatacccatagagaccaaggattatccgacaccggccagccggccgcattatagcgtattgaataaaggtaagataaaaagcacgtacggactgacgattccccattgggagactagcttggcctactgcatgaataacaaagtgtaactgataacaatatatacatataaaatagaatgagccagtattcagaagagattgaaagaagaagaacgtttgccataatcagccacccggatgccggtaagactacgcttaccgagaaattattgttatttggtggcgctatccatgtagcgggagcggtgaagtctaataaaatcaagaagactgccacgtccgactggatggagattgagaagcaacgcggtatctccgtagctacctccgtaatggcttttgattattccgatcataagattaatatcttggatacaccgggccaccaagatttcgccgaggatacgttccgtaccttgacggcggtggatagcgttattatcgtgatcgatatcgctaagggagtagaggcgcagactcgtaagttgatggaggtttgccgtatgcgtaagactccggtgatcgtttttgtcaacaagatggaccgtgatggtaaagatccttttgatttgctggatgagatagaagaagaattacagataaaggtacgcccattgagttggccgatcgatatgggacaacgtttccggggcgtatacaatattttcgagcagaaactgaacctatataccccgagtaagcaatatgtgacggagaatgtggaattcaaggatatcacgagtccggatctcgagacttatattgatcctacgcaagccgcaaagcttcgtgaggatatagagttgatagagggggtttatcccgaatttgatgtgaatacgtatttggatggggatatcgctccggtattctttggctccgctctgaataacttcggtgtgaaagagctattggattgctttatccgtatcgctccctcgccacgtccgatccatgcggtagagcgtgtggtagacccgaatgaggataatttcaccggctttattttcaagatccatgcgaatatggacccgaaccatcgcagttgtatcgcttttgtgaagatttgttccggtcgttttgagcgtaatgcgaactataagcatgtacgtttcggtaagatgatgcgtttcagtagcccgacggctttcatggctcagaagaaagaagtggtggatgaggcgttcgcgggtgatattatcggtttgccggataccgggaactttaagataggggatacgttgacttccggagaggaattgcatttcaaggggttgccgagcttctcgcccgagatgttcaaatatatagagaacgccgatccgatgaaggcaaagcaattgaacaagggcatcgagcaattgatggacgagggtgtcgcccagttgtttaccaatcaattcaatggccggaagattatcggtacggtgggacaattgcagtttgaggttattcaataccgcctgttgcatgagtatgccgctcaatgtaaatgggagccgatcagcctatataaggcttgctggatcgagagtgataaccaacaggcattggagaatttcaagaaacgtaaggcgcaatatatggcgttggataaggaaggccgtgatgtttatttagcggattccggctatgtattgatgatggcccaacaggattttccggatattaagttccattttacatcagagttctaatatgaaaagtcgattctccatcctttgcttacttgttaatatcttgttgataagttgtgaacaggctccccaatactatgaggtatccggaaggcttcatacaccttatcatattaagtttgagcatactaaaccattggataaggagattgacgagcagttgaaatatttctaccacctgtttaatgcttttgattctacttcggtaatcagtcaggtaaaccagaaccgtgacatacgggtagatacgctcttccaaaaagtctttaagaaggcactggaagtatctgccgagacaaatggggcctacgacgtgacgtgcgccccgttgatcaacctttgggggtttggcttcagccggaaggatagcgtaacccctgcccatatcgacagtgtccgtcagtttatcggttttcagaaagttcgtttagaaggggatcgcatcgtgaaggacgatcctcgcttaatgatgaacttttcttctttggcggatggaacggcttgcgatatgatagctcagatgctggagaagaaaggggtccgtaattatttggtggagtttggtggcgagatgcgtgtgaaaggcgtgaatccctcgggcatggattggcgcttagggatcacgaagcctacggatgacgctgctggcatgaatcaagaactcgagcagatcgttagcttcccgaaaccgttaggaatggctacatcaggcaattatcgtaatttttatataaaggatggacgtaaatacgcccatacgatcgatccccgtgaaggttgccctgtacagcgggatatccttagcgctacgattgtctccccggatgccatgaccgctgatgcgtatgctaccgcatttatggtcttaggttcggaggaggctaaatccttatgcgctaaagtgcccggccttgactattttattatttgttccgattcgataggagacgggtatcatccggaatactctgagggatttcgccgatacatggtgactgccgataagtaatcagttaatttataatgtattaagatgtagttcttagaataggcattgtaaggtctttatgatgcccattctaaggatcatataatgcccatcgtaagcactctataatgggcattgtaagaaaggatatcttataagatggaccggatctcatccaaggagcggactgtataggttgggatgaagcctacggcaggtaatccttcaggattcaaccatatctggtcgatcttggattggtaagccccaatgatatcagcttcccagctatccccgatcattaagctctcggaccggcgtgagttcgtgttctttaaggcgaagtcgaaaatacctttatggggtttttgtatattagcgtcctcggacaggatcatccgttcgaaataaggagccaagcctgcgttgctaagtttcttgaattgtacctcacggaatccattggataaaataaataaccgataggaagggcgaagatattccagtaattcaatggctccgggcactaatcgggttttggtggtcgtgcgttgcaagaaatcattatttaccgataagacggttttcttatcttctattcctaacggacgaagtacatagagaaatcgatccaagattaaggtttgccggtctatttcccctgaacgatacttggcccataagtctagattatgaggcatataaatatcaaagaaagcctcgaaggaggcataataccgattaaagtggtaatcggtatatagctcttcaaggcattctttattgttatggtacgtatcccaaagggtatcgtccaaatcgataaatatacttttataaatcattatccaacttcgatcactaaatacttgcctaggctccagaaagccttctcgtcatttattttcaaggtcaagtttccgtcttcatcctctacgaactcataagatccttccggatgattggattttagtttagccttgcttgcgaacaaaggaatttcttttacctcacggatatcgatagagatgaaataatccttgttgaaaccactctgcaatactttagatttagagaacaggccaccaccggataagatcttctgttccttcaattccttggaagtaccgaaacagtagtaagccgtgtgaagggctttatcttgagcgttcaatttctcggattgagcggctgcggtagtagccagactttccacatcctcattcaaggaacttaccatctcgtccaattcttggatacgtacgttcttctttgccaaatcctcttgcaaagcgacaatcatcgttgccttttgatccagctcggaggaaagacgatcgatcgtctttcgtaatgcggaagattgaataccgcttttcttcaatttctcctccaactggctgatttgctccttgttcttcttcaaggtctcgctgatcaattgcatgttctgcttgatttgatctctgcgtgactgatttagctcaccgccggtttgttgttggattgtcaaataattctcggcatcacgtatagattgaaaatcagattcaatatcatttagggtggagagcatatcattaagctcatccgtgttcttcgtattctcgatacgtagagaatcgttctcagcctttagtttcttgtaatccgctgaattttggccgcaagaggccagcatggctgtgcagacacatactaataatactttcttcatgttctttttgcttgttaagttaaacatctttttctgtctctttgtcctttttatcttttaagcctgctaatacaataacaatctcaccccttggttcgttcacggtaaaatgctgaattacttcttctaaggagcctcgtacggtttcctcgtgtaatttggatatttcccgggatactgatacttggcggtccgtaccgaaaaactcggcgaattgtgtcaaggtcttgagcagacggaaaggtgattcataaaaaataatagtccggtattccaaagccaattcttttagccgggtctgccttcctttcttttgagggagaaacccctcgaaacagaacttctcattgggtaatccggacgctaccaaggcgggcacgaaagctgtagctccgggcaggcactctacgtctaccccttggcgaacacattccctcaccaacatgaatcccggatcggagatggccggcgtaccggcatcggaaacaagggcgatattctcgcctcccttgatacgggccgcgatttgctccaccgtcttatgttcattgaacttgtggtgggactgcatcttgttttgtatctcgaaatgtttcagcaagatgccggtcgtacgggtatcctccgctaaaataagatcagcttcttttagcacacggatcgcccggaatgtcatatcttccaagttaccaacaggggttgggactacagtcaattttgccatatcgtatatttatgagaagcgtttttccaatagcttgatgaaatcggctacggaagcgtcttctatattccagttcaacaccttgttcagataagtgaccgattcctcgtacgagctaagatcgttcaggtctgagatcgccttattcattttctcctcatttcctccgaataattcccttctgaagcggaaacgatcatttaaactgaatgccttacggaaatcagaaagattctttttctccaatatatcattcagtgaaatactggatttatccgctaatatagttttatgtggaatctctatctctttcaaggggattgtctcttgtacgatcttttcttctgggatcactttttcgacaattggttctactacgataggttcctcaacgaccggttcttgtacctgtacgacctcgatcgtaggggatacttccggagccggttgcacctccggcatctgtaaaggtttacttacgggaatagaatcgataagtcgttgatgttcctccatttgtttacgcaaagcctctaactgaaactcctccagcgtatgaagctccttcaataccttgtgggtcaactggaaggtctggttgaagaaagaggcgggataaatttccgcgtccctcattccggctaccaacttctccagctccctgatatcgatcaatagataatctattttttccttgtttgccatttctatatgtttttcagatgctataaatcatccggacatacgtatgttttgcaacaaaaataagtatttcttgtcaatgttgccagtttcgatcttaaaatattgtaaatcattcgacgaactcgtccggtaaattcaccagatataggtgatgggtcgcccgggtaaaagccgtgtagagccaccgatagaaatcctcaccaagcatttcctccgtgatgtaaccgatatcgagaaagacgttcatccattggccgccttgggctttatggcaggttaccgcataagcgtattttacttggacgacgttgtaatgaggatctaccttcatctttttcatttttcccgccttggtaggaatgtcctcgtaatcttccaatatggtgtaaaagagcttgtcgtttagctccttagggagggcgggggagtcggtctgtaaagtatctaataggattttcaaatcgatttccagatcataatcttgaaaacgagccgtgatgtcggcaaagcggaagccatacatctccgtgacacggcgtactcgcatgacttgaatgatctctccgttcgctataaagtccatctccttgcaattcgctgtccaataataattgttcttcgctaccattaaatgatcgccggacgatagctcttcttccctgtataggatacggttacgtatgccgttattataaatcgttgctcgtttattcgagcgggagataatcattgtctcttccataccgtcgcggctataggcggaagatatttcctcaattagctcatctccattgactttcgtgaaatcggagaagccttttaattgtaatttcggaaagatctcgaccgtgtggtttcgtagtgcgtctcgtagccgggttgcgttgaacaggattcccgagtcctcgctttggcgtacgacttgagttaacgctatctcccaaacctgtaggttgtaaccccgtaatatctcgggattcaaggcgggactctccgtttgcatcaccggaggaagctgtgcgacatctcccattaggataagacggcagttttccccggaatagacatactggattaaatcgtccaacaggcgtccggagccaaaaacaaatgaatccaatccctcgttggcgatcatagaagcctcgtcgacgataaaaagtgtatctttatgtaaattatctgccggcatgaagcccgtcggctcattggaaaacgcccgttgacgatatatttttttatgaattgtatacgctttttggccagcgtagcccgagaaaactttagctgctcgtccggttggagccaacaaaaacgttttttgctttagttcgttaagcgttttcaccaaagccccgaccagagaggtttttccggttcctgcgtagcctttcatcagtagaaggctgtccggttcctcagacaagagaaattcggtaagcgtatgaagcgctaaaaactgatcatccgtcggtttataggggaaatttcgttcgatttgctggcttatgtaactatttatcattttgatcgcaataattttcgcgataaaggtagtgtattaaatattcttttttaaatttgccgaacgaaataaattcaaaaaacaatacaaaccatgaaagttacattaaagattttattagctgccgcagttgtactgctagtttacatgtgctacaagagcgtcactggtccgattgagtatgatgatcagaagactattcgtgacaatgcgatcatcgcccgtttgattgaaatccgtaaggctcagatcgaatacaagaacatgtataagactcatgccggaagtttcgacgatttggagaaattcttgaatacggataagttgccgttcttgatcaaggaaggtgtattgacggatgagcagttggagaaaggtatgacagaagcagaggctgttaagaaaggtttaatcagacgtgataccatgtgggtattggcgaaagatactttgctgggtaagaactatgatgtagcggctatgcgttatgttccggccgttccgggtgaaaagattactttcaagatggatacggctacgttgaaatctggttctggttatgagatcaaagtattcgcttgtgaggttccttacaaagaatatttgcgtgacatggatgctcagttgacttataacttgatcgacaaggcagagaaacaaggtaagttcccgggattgcgcgtaggttctttggaagaaattaataacaacgcaggtaactgggaataatcagcggctcatatgactatcagcattcctgatacgttaactactgataattcggaaaagtatatagtgtccatccggcttcggtcgggtggactttctttttccgggtatgatccctcggctggaggaagtttcttttatcgggaaacggaattcgatcgggcggtctctttcatttcttcccttaaggagtttttcttcgctcatgagtttcttacgtggacttataaacggattaacgtgatctgtgtatctccggaatatagcttggtccctgataattattggggggacggtaaggaagggcatttattggatttctgcttttctacactggaattgcattgcttaaccgatattttaaaggaacaacaggctaagttggtgtttggtgtggacgaggaggtttacgaattttgctcccgttctcttttgcatccttttttctcccactacatgacttctccgctaacgctatggacaaaagaaagtagtgctagcttaccccggcaaatgtatgtcgtgatagaacgaaagcggatggatgtggcgtgctatgctcaagggaaactcttatttgtgaactcttacccgatcgaccaatcggacgatatagtatactatatattatatgtatggaaacaggcgggattggaccaagaaaaggaccagttgcttttagcgggggaatcttcctcgcaaatgcgggttctggagcgattgcgagcctatttacgccatgttaagccggtggagatcccttcggaagcctatttgctgggaacggatgtaacgaaagcccctatggatttaatatctttattaatatgcgaataataagcggtatatacggtcgtcggcgttttgacgtgccctcttcgtttagcgcacgtcctacgacggattttgcgaaagagaatatttttaacgtagtaaataatttggtggatctggaaggtatggatgcgttggatctttttgccggaaccggaagtatctcttttgagttgatctcacgaggatgccggaatgtaaccgccatagagaaaaataacgctcatgcctcttttatagccaaggtagcgaaagagctgaagacggatgcgttggctctgattcgtggggatgttttccgttatttgaattcagcccctaagcaaagtttcgatttcatctttgccgatcccccatatgccttgccggagttgccggaaatacccgccttggttttcgagcgtgatttactaaagaatggagggatattcatcatggaacatcctaagaccaatgacttctcatctttgccttatttttatcagcaccgggtgtatggctccgtgaactttagcatcttccttaaagaaggggagaaaacagacgcataaatgattccgccatgcgttgcttgagggggcgctttaaccagcgggaagggatcaaacgctcacagtgatgcatgtcgtgtgtaaagatgcgtttcatttgcagggcgaattccttttgatatacgaaagcgttaatctcgaagttatgctcaaagctacggaagtccatattggcggacccgatgcttgtcaatgcgtcgtcggacacgactagcttggaatgcaagaagcccggtttgtagaggtatacttttacgccggcctttaccatctcgtcgataaaggaatgactggccatattcgctgaacgtgtatcggaacgcttaggcagcatcaaacgaacatccactccccctaaggcggcggtttgcaacgcttggtttaatccttcggtaggcaggaaataaggggtttgtataaagatatacttcttggcgttggcgatcatgaaaatggtcgcttgcaacaaagttctccattgacctaccggaccgctagtggcgatttgcataatattatcgctatagatttcggcagccggatagtaaatccgatcgttcaagagttttttactaaccacgtaccaatcgatgaggaatacggattgaagcccgtgtactcctttccctacgaatttgaaatgcgtatccctccatgtgccccaagaggttcccttatcgtatcggtcggctatattcatgcctcccataaacccgactttaccgtctatcacgataatcttgcggtggttccggtaattcaccttactggtgaaaacggggaacgctaccctcaagaacgcatatacctcgatacccgcttccttcatttccttaaagaagccgtcttttacattccagcaacccacatcatcataaagtacacgtaccttcacgccttcttttactttcttgataaggagttgttgcacctgttttcctatctcgtcatcacagaatatataatattgtatatggatatggtgagtcgctttctggatctcttccagcaagtctttgaacttatcggtaccattcgtataaatcgtgatttgtgttccgtataggagggaggattggttggtgttagtcaacaaggtcgataaaggtttataggggtccggaactacgcaggcgtcttgaggtaatttaccctcttgcggccttttcatgatgcgtttataggtacgcctcgatatgatccgttgtttccggttatcttgtccaaagaagaaatagaaaagcagtccgataccgggtgctaataataagacgattacccaaggaattgtctttaacggattcctattctctgtaatgataactaataccagtcctaatatagtgacgctatacaatatgataaatatcgtaccaacgattaactgtatatgaatggctgctaacatgaaactctctctttgctataatctgctataatttgctaagataagaatgctttccgagaatagcaaatttccgtattttttttgggctgtatagaagggccaaaaagtaagctaacttaaatggcaaagtaagctaacttaaatgcccaagtaagttaacttactttgccaacgaagctagctgactttggaagcggggttatgtacattttaaaataatgaggttgttctctaaatataaagtgtcatttgttgattttggcgcaggctattatgagaagtatctatgataacaataaaaatatttagattgaaaacgactgtaaaaaacgatcgtttcaattattcgtttgcaaaggtaggcatttctccgagactggcaaccttttccgattaaattttgtcctgctatatatctttttctcaacaggatatattaatcaaagtgtcacgaatatgacaaaagagcatcatctttttgctttctaaaaaaatgcaagatctaaacgatcgttttcactagtcgttttttatgtggaagggtaagaataagaaaaacagtaaaccaatgataacttggaatcaaactctagagatatgaatagaaagtcttctatacgagccattttactccgtaaggaatgccttttattctttttgctactattgcctatgtttacaaaggcgcaatataataaggtatatgcggatatcaccgcgaatatgctggtcgatatgggttttgagaatgttatctggtcggaagacgagaaggagagagtatatgtcttggagaataccccttggcgtttgcagggtgtgggactggcccatgccatagaccgcatccagaaaacaggcttgccggagaagggcaaatcctgccgtatcgtcgtattggataataatataccgcagatctcattgatctatacggcaaatccggacagcttgaaggcggctcccggctcctatgcggcccgttccgcctgggatgctacttacgatctgggcgatagctgggataaggtgaaaaaagagtaccgtatgaatagctccttatttaaagtagacgtggtggtttatccagagttgtatctgaagaacctcattatcacgcaaatataccaagtattattcaacctctcgcctgcgatcgaggtctctttctggaatgggatgaagctgacggcgcagatggtatttcctatatataatgatggatatggtccttgggcgggtaagattcacccgggcatggttaccctttcccaatcttttcgtttaccttatcgtacgttcgccagagccagtatcggtttgttcaatgcggatcgttatggcgtggatttagcggtaacccatcatttgaaggatgaacgtttttctttggaaggacgtattggttgtacgggtacgggatcttggcagaagtttgaatatcattatggaactcaccaacgggtgacatggtcgctgggaggtagtttctactggccaaaatacaatacgcaagtctccttgaaagccgagcaatacttactgggtgagatcggaggacggattgacttgatccgccattttcgctattgttcgataggattttatgcgatgaaggcgcaaggtgctttgaaaaacggcggtttccggtttcaagtggctcttcctccttataaatataaacgtaagaatgtgcgggtgcttccttctgacaactggggtatgtcttacaacgccggtaatgaacgctattattataaggggtataaagcctcgccgaatgataacatcatgcaacagaatcaattcaacccgtactttataaagtcggaattactcaatttttaaatagttttattatgagaacaattacaaagttacagaccttattggtcttgttccttacgacagccatggtatgtttcatgggctgtaaggatgacgatgatgatgtgcctactccggatggtggtggcactgttgccacctatgcgattagtggtacggtcatggatgccagcaacaacccgatggctggcgttagcgtagctctttctggagctcaatctcttagtgctacgacgggttctgatggaacgtactctttcgacttgaaaagcacaccaggctcttacaaaatcgcctttaagtcggaaggctatgcagacagaagctatgatgtggatgtgaagaagatcgaatcgggtgttggacagtatgtagtaaacgccgtcatggtaaagggcacgactcccgatactccgaaagagtataagaaggcgaagtacaatctttccgtatcgatcgaggatgttgtgggaaaagctatctctacttccagcctttctgttgtcgtaaaatacggggataaagagatcgctaaagagaataaacctaattttaaggtctctgatgtgactcccggtatctacgacgtagtagctacagcttccggatatactaaagccgtggctaaggttgtcgtttcagccgttccggatcaagaaaagaaagagggcgaaggtgatacattcgacgttgagtatccagctattatcgtgatgaatgtcgctccttctattccagtagacccggatgatccttctaagccgacagatccttctgacccgtctgatccttccaagccaacagacccgtctgatccttccgatccttccaaaccgacagatccgtcaaaagcgacttatatcgtatctggtataataacagacctatctacgggcgcagacatcaaaacagcggaagtcacattgatgttaggaagtgaagagttatttatttctaagaatgagagtgagttctctttcaatatcgcatcatcaaaggttacggaggatgctcaatttatcttgagtgttaaagccgcaggttatacgagctactctcgtacgatcatctttaaggttggtcagagtatgaactatgtatttcctatcacattgaaccctgtaggtacaggtggaaatacggagattgatttttctaaatatggtgttcaggttccggaaaaagaagcggaaaaagtagcggatgagattaagaatgcgattaacgcaggcggaaccgaagaggttaaggtgtctggtgtcacttatgtggatgagaataatgttgagcaaaaagtagacgttgtcattcctgctaatgtcttagataactataaaggtgcggataatgaggttcaagctccagttattaaggtcttgaatcaaagtgatgctgagaaattgacagaatcgataggagtgattgaaagtacgaccgctgatggtataaaagagaaagatgaggtaagtttggtcgcggaaagtggtaagcctgtcgttatcgttatgccggcaagtagtaatcaaacattggtgatcgaacgtgatatgtctgcggaagctctgcaatccaataatgtgacttctgatgctggtgcggtagccagtgtaagccgtgtatataaaggcgagcctagcggtacggtattctctccggctttgaagatctcgttcgacgctccgaaggatttggtttcttctacacagcctatggcattgttatatgcgaccacaggcatagataataaggagatcatgaagattgatcctacggcggaccctgtttatatcaatggtactggtgcggaaatgtctgtcgctcacttctctaagtttgccgcaggttttgagttggcattagcggaaactgaagatatcagtactgatactacaatcgtagaaaaggttgttgactactgttctgatggtaaggcaggaaacattcctgtagttgttacaactacaaatgcttatgttggagaaaacttgcaggatctagtcggaaagtctaacgtagatggtcaagtcgctaagaatgcggtttataaccgaatctctaatcgtttgcaagctgatggttatcagattggtacccaaacatcattgactacatccgttcctacggaagctgatcgtacggtcgcttctatgagcttgaagaagacatatactacaaatacgtatgtatttaagtttatgacaaagggtaagaaggtggaagagattcaggttgtagctaaaaaacttatcaagatagaaggtactcctgtctacaagcaatcccacggtcacggacatggtgatggcaataacgccggtggcggtatcatcatcccggattaatgcttgatatttgaagcttgattaaataatgttgagccggaagtttataagtaaacaaagaaaaatgaagaaattactcttattaatcatattcttaagttgctggaccttacttccggctcaattatcttatggcacgacagggctattgcatgccccgtccgccgatatgcaaaaggacaagaccgtgatgcttggcggaaacttcttgcatcaagagcttacgcctcccaagtttaattttaatacgtggaattattatttgaacgtgacgatcttcccgtttctggaagtagcgtatacttgtacgctgtttacggccgagagccttggattggataagcatggctattccggattcacgaaccaagatcgttatttctccgcccgcttacgtgtgttgaaagaaagcaaatacatccccgctgtcgtgctggggacttcggacccttttacgtcatccgggcataaattcgcttcagccatagggaacggctatttctgccgttattatctggccgctaccaaacattttcagctgggaagggaaaccttaggcgttcatttatcctatctgtataaccgccgtgaggattatcccttgaacggtgtagcgggaggtatcacctacaatccttcattcgccccgcatttgaacgtcatagccgaatacgattcgaaagacttcgctatgggagccacttacctgctattcaatcatatacattttcaatttgaattgcagcgaatgaaatatttctccggtggactgtgctataagatttatttaaaataaaaagaggttcagcttttgtccgtttttaatccgcttggaggcgaacggttaggctgaacctttttatatcttgttacgctgtcgcgccagccatatctacggctttattccccgatgaaattcttgcgtatcaactcggcggacttgtactcctcttccagatacgtctcaatatgccgtttcttcttatcctctaatatctcgttaatagcgattaagatacccgtttcttccacctctccaaactcatggttgatcgctgtgccgaatacacgcatcttaggcgacaagctcatgtaagcatttaccaaaggaggcacgttgatgccgaatttacgaacctcttggttcaataccttgtagttatccttgaaattatcgtgagggaaaagagatctcatcttctctacatccatattagtctccaaaggatataccggagtgatcagttggtctgcgtccgggaaatgcaatccgaggaagtataagatcatattacgggcctcttggttgtacgtattgtacatagtcaccttcccgaaataatacctcaagctcggatcaaccacggataaagcccccaatccatcccacaggttatccaacacgaataagcctttcgccccggaacgggtggattgatactccagagccacgaacgagcgtcccaactctaccgtataaggaaggatctccttgataaatttctctgagaaattaaacaagtgcgaggtcgccaagatcggtttgccattctcgtcgaacttaacgtccgaaccacaaaggaaacggtatccccccaagatctgctcatcttccgggctccagacaatcagctggcggtaagcgtcttccatcgtgtcatactcatcgatatccacagggaatcccgtgccacccccgtaataacggaaagcgacctcccgcagacgccctatctcttgcatgacattgggtgagtcgtgcgccgtgacgatataaatctcattcttcgatttattggtacttctcaacctcttctctttggtcaattcagccttcagtagtgccctgtctatgggattgataatgtcttgcatatgtttcgtctgttaatccttgagtttgtaaaccttgttttttatccactcagcccattcggcgggtttcttgctattgtcgaatgtctgccaagggataggcttcccgaaataaatccggaaggtcttatgtttgctccggaacatctcgtccggtaaataaatcatctcataattcatctttatacccaacgccttgcgtatccgggcgaggttatagaagaaattggaattcttcccgtcgaaatagaccggtacgatatcccgcttgtattgcaccgccttctggatgaacgatttcttccactccaagtcttgtatcttgccaccaatcttgcgagagcataatccagcggggaaagtgatgatctggtcgtccgaggcaaaagcctcctccagcatccgtgcgttgtcctttccttgggtgccgtgtttgttgatcggtacaaagatggattttagattggagagataaagtaataaatcattgaccggatacttgatgcggccttcgaaccgggaaccgataacggcggagagacagataccgtccaatcctccgagcggatggttggaggcgaagatatagcgcccttcggtcgggatgttttcctcatgtaccagatcgagggtaaggtcaaaatagccgataagctcacgcatgaaatctaccccttccttatcgtggtaacgggttaatatatcattcagttcctcttgatgaaccgtgcgaatcaagtagtccacgataaatcccggaatcttgcgtgacgccttgggcgccttttgtgccaatacttgcttaatatctatctttgtcacaccttgttttgccatctatataagcttgtcaaggggcaaagataaagttaataattaaaacgagagaggtttgagtgaagtttttgctttttcgccagctatcttggccttttccccttgatcttttagccgctaccattagggaggttagtccccgggcgcttgactatcggttatctaacggctgttggacgatcatgcaccatctgttagaagatcatctaccaactgttgcatgatcgtccaacggccgttagaagatgaaggtgaaaggaagaattggttaacggataccggtgaaaagcgtaagagataaggacgaaaagacgaagggttaacgacctgttgataactttttcctacttttcttatataaatgttggcgggtaattttggaaatgtgtacttttacccaccgataaggcatgtgcgtgcgtatcaaaggagtacggcgctttattttaagaggaagtttaacgtaagaacgacgaatggaagaaaaagatagttgctatcatgtaccggtaatgctgcgggaaagtctggagggattggatatccgtcccgacgggatttacgtggatgttacgtttggcggtggaggacattcccgcgagatcttgaaacggttgggtagcgagggcgaactttacggctttgaccaagatgcggacgcggagcataatatcccggcagatccacgattcactttcgtgcgcagtaatttccgttatttgtataattttatgcgttactatggagaaagcggggaggtagacggtctgttggcggatttaggtgtctcttcccatcatttcgacgataaggatcgcggtttctctttccgtttcgacggggcgttggatatgcggatgaatacgcgtgcggggcagaccgccgctgatatcgtcaataattatacggcggaggcgttggccgatgtgttttatctatatggcgagctgaaggtgtcacggaaattagcctctgtgctggtgaaagcccgtgagacaaagaagatagagacgatcggggacttcttggaggtgatcaagccgtttacgggaaaggacaaggagaagaaattcttggcgcaagtctttcaagcgcttcgtatcgaggtgaacgatgagatgagggcgctgaaagagatgctgcggagtaccttgcgggtgttgagaccgggaggacgattggtggttatcacgtatcactccttggaagaccgtctggtaaagaactttttgaagaccggaaacttcgaggggaaatgcgagcaggatttcttcgggaacgtacgatcgcctttccgcttggtcaataataaggtaatcgtcccgaccgacgaggaggtggagcggaatccccgttcccggagcgccaagttgagaatcgctgagaaggtataaggagaaatagatatggaagaaaacggacaacataagaaaacgaggaagaaggagaagcgtctttcgttctggtatatactcggtggcggcgtgctgaaagaggattttatcttgaggcatacgcgcatgatcgtgttacttgtcgtgttggcgtttttctttatcggtaaccggtatacttgtatgcaaaagctgcgtgagatcgaccggttgcaacagcaattgagggatgtgcgtttcgaggcgttgtcgatctcatccgagttgaccggcaatagccgccaatcgcaaatcgagttgctgatcgaggagcaaggtattgatctggagggtgcgaaaacccctccttatgagttatataagtgagataaggtgtaaataggtatgtctgaagaaaacgaaccgaaagaaatagagcctaaaggtagccggattttattctgttacttcgtggtcgtgctgttgctggggcttgtggccgtaggaatcctgttccgtgcctttgatacggccttcgtggagagggataaatggatgaaggtggccgagagccagaaacgaccgaaccgtttggtgttgcccggacgtggcaatatctattcgtcggacggtaagttgatggctaccagcgtgcctcgttattatatgtatatcgactttaaggcggatgcgtatactccggctaaggatgccaagtataattggctggatacgttcaagacgtccaagaaggatggggtggactcgttggcgttttatctttcccgtaaattgaaggatcgtacgccggcgggctataaggcttatctgctgaaagggctgagcggtaaaagccgccagttcccgatttacgcggggaaggtctcgtattcggacttgaaggagatccgtaagttcccgttccttcgtctgggacgttataagagcggtttttatacgaaggagatggtgcagcgccagaaacctttcgggaccttggcgtctcgtacgatcggtgatatctacggagagatcgaggagggtggaactacgaaggggaagaatggattggagttgcaatacgattcgctcctgcgggggcaggccgggttgagttccgttcgccgtgtcggtggaggctggacgaacgtgattgaggtggacccggtggatggcatggatattcgcaccacgatcgatatcaatatacaggatataaccgagaaatcgctggtcgataaattgaaggcgatcgatgccgagtctggtacggctgtcgtgatggaggtcgagaccggagagatcaaggcgatcacgaatatggggcgtatccgtgagggcgtatatggcgagacgaagaaccatgccgtggcggacgagatcgagccgggctctactttcaaggtggcctctatcatggtggccttggaggatggtttatgcaatccgggagatacggtcgatgtaggcaatggtatatatatgtataagggggcccgcatgacggaccataatatgaataaaggcggatacggtcggatctcggtggagcaggcgatttggtattcctccaatatcggtgtggccaagacgatcctgaaaggttattcggataacccgacaaagttcgtggagggactgtaccgtatcggtatgaacgcggatcttcgtttggagataccgggggcgggacgtgccaagatacgtcgtccggatgatacgacccgttattggtccaagaccactttgccttggatgtcgttcggttacgagacgcaggtaccgccgatcaatacgttggcgttctttaatgcgatcgcgaacgacgggaagatggttcgcccgatgtttacgaaagagatcttacataacggcaagaccgtgcagagtttttccacggaggtgatcaactcttcgatctgctcggatcatacgctggcgttgataaaagatatgttgctgggagtcgtggagaaagggaccggtaaggcggttcattcggatattgtccggatcgccggaaagaccggtacggcgcagatcgctacgggcggtgtctaccgtacgagcgggcaccaagtctctttctgtggctatttcccggccgatcatccgaagtattcttgtatcgtggtgatccgccgtccccgtattggttatccttcgggcggtacgatgtcgggaggcgtggtgcgtgcgatcgccgagaagatatacgccagccatatgtcgttcgatgtccgggatatggaacgggattcgatggccgtgatggtacctcgtgtgaaaggcggcgatctgagggcggtagaggacgtattagatgaattggatattaaggcggatacggacagtttggagacaaagtgggtcgtagcctccgccgagcaagaagagaataaggtgaaattaagcgatctgacgattcgtgagggcctggtaccccgggtagtcggcatgggtgctaaagatgcggttttcttgttggagcaagccggtctgcgtgtctctttgtcgggtgtcggacgggtcgtttcgcagagtattcaacccggacagcgagtgtctaaggggcagaccgtattattaacattgaaataggtatggaactaagggatttaatcggtgcgttggaagctcctatgttgatgggggcggataatgtggatatcacgaatattcaatcagactctcgtcgggtgacgaaagggtctttgtttgtcgctgtgagaggtacggccgtggatggccatgcctatatggacagcgccatagagaagggggctgtcgctatcgtatgcgaggaggctccgtcctatttggaggggagatgctcgtttatcgtggtgaaggattcggcggaggcgctgggtcttttggtttcccgctggtatggtgatccttccgggaaattggtgttggtaggcgtgacgggtacgaacgggaagactacgatcgctaccttattatatgagatgttccggaagatggggcataaggtgggattgctttccacggtatgtaattatatagatggcgaggcggtaccgacggatcatacgacaccggacccgcttacgcttcattccttgatggcccggatggtagaggccggatgcgagtatgcttttatggaggttagctctcattcgatcgatcagcggcgcatcagcggcttgtctttcgacggggggattttcacgaacctgacccgcgatcatttggattaccataagaccgtggagaattacttgaaagcgaagaagaaattcttcgatgacctgcctgccgggactttcgccttgacgaatgccgatgataaatccggcttggtgatgttgcagaatacgaaggcgaaaaagctgacctattccttgcgtaccttggccgatttcaagggaaagatattggaatctcatttcgagggtacagacttgatcattaacggtcgggaggttatggtgcatttcgtgggacgtttcaacgcttataacttgctggccgtgtacggagccgcggtttctttggggaaagatcccgaggaggtgttgatcgtgctgagcacgcttcgctccgtatccggtcgcttcgagacgatccagtctccgctcggttatacggcgatcgtggattacgctcacacgccggatgccttgacgaatgtactgaatggcattcatgaggtattggatgggaaaggacgtatcattaccgtggtaggtgccgggggaaaccgggacaaggggaaacgcccgctgatggcgaaagaggctgtcaagctgagcgatcaggtaattctgacttccgataacccgcgctttgaggaaccggatgatattattaacgatatggtagccggattgacgaaaatggatatggaacgtaccttatgtatcacggaccgtacgcaagcgatcaagaccgctacgatgttggcgaagaaaggggatgtgatccttgttgccggaaaaggccacgaagactatcaggagatcaagggggtgaaacatcactttgacgaccgtgagaagttacgcgagattttttcgacacaacaatcataatatttaagacgacatgctttattatctttttaattatttggatcagttggatttcccgggagcgggtatgtttaagtacgtatctttccgctcggggttggccttgatcttgtccttgtttatctctacggcgatcggccggcgtatcatcgataagttgcaaatgttgcagatcggcgagacggtgagaaatcttgggctggagggccagatgagcaagaagggaacgccaacgatgggaggtattatcattattatcgctatattgatcccgactttactgtgtgccaagctgaataatatctatgtgatattgatgttggtgactacggtttggctgggagccttgggattcgcggatgattatatcaaggtgttcaagaagaataaggagggcatgcacggacgtttcaagatcgtcgggcaggtaggactgggcctgatcgttggcttggtattgttcatgagcccggatgtggtgatcaaggagaatatggaggtgcgccatgataacgtgatcgaggaggtgcgttatcatacggtggagaccaagtcgacaaagacgaccatcccgttcttgaaaaacaataatttcgattacgccaacttggtgaactgggcgggcgattataaggaggaggccgcgtggctagtgttcgtgctgatggtgatctttgtggtgactgccgtgtcgaacggagccaatatgacggatggattggacggcttggctgccgggacatcggcgatcatcggggtggcgctcggtattttggcctatatgtcatcccactttgagttcgcctcgttcttgaatatcatgtttatacccggcgcggaggagttggtggtttatgccgctgcctttatcggtgccacggtcggtttcttatggtacaactcgtatccggcccaagtatttatgggagatacgggtagcttgaccttgggaggtattatcgccgttttcgcgatcatcatccgtaaggagttgttgattccgatcctttgcggtattttcttggtggagaatatatcggtcatgttgcaagtggcctactttaaatatacgaagaagaagtatggggaaggtcgccgtatcttcaagatggctcctttacaccatcatttccagaaaccgggaaacgcgggtatacaggcattgatccaaaagccgttcaatgtcgtgcctgaatcgaagatcgtggtccgtttctggttgatcggtattattttggctgttatgacgatagttacgttaaagatgagataaaagatgagtaagagaatggttatattaggggccggggagagtggcgcgggagccgctgtcttggcgaaggcgaaaggattcgacgtgttcgtgtccgataaatcgtctatcaaacctaagtataaggagatgctggacaaccacgggattcgttgggaagagggacagcataccgaagccgacatcttgagtgccgacgaaattgtcaagagcccgggtattcccgacaaggctcctatcatacagttattgaagaagcaaggtacgccgatcatctccgagatcgagtttgccggaaggtatacggactcgaagatgatttgcatcacgggtagcaacggcaagacgacaacgacgatgcttacgtatcatatactgaaagaagcgggcgtggacgtgggcttggccggaaatgtcggaaacagcttggcgcttcaggttgcggaagatccacatgcggtctacgtgatcgagttgagcagtttccaactggataatatgtacgactttagagcggatatcgctattatattgaatataacaccggatcatctggaccgttataactatgagatgcagaattatgtagacgctaagttccgcatcttgcaaaatcagacgaaggacgacgccttcattttctggaacgatgacccgatcatagcccgtgagatcgccaaacggcatcctgaggctactctttacccattcgccgagacacatgagaacggcgtgaagggatatacggaaaataatcaagtagttattgaaacggcaaacggaacatttacgatggaacaagacctattggcattgactggtacgcataacctgtataactctttggcttcggggatagcgtccaagatcgtggacattcatgatgagaaaatacgtgcctcactcagtgatttcacgggtgttgagcaccgtttggaaaaggtgcttcgcgtgcgtggtgttgattatatcaatgactcgaaagctacgaacgtaaactcttgttggtatgccttgcagagcatgacgactccggtcgttttgatcttagggggcacggataaagggaatgattactcggagatcgaggaattagtgaataagaaggtacattcattgattttcatgggtgtggataatacgaaactgcatgcgttcttcgacgggaaagtggcgaatattgaagacgcccgctcgatggaggaggctgtggcgaaagcttataagatggctcataagggagatacggtattgctctctccttgttgcgccagcttcgacctgttcaagagctatgaggatcggggcgatcagttcaaggcttgcgtacgtaatttgtaataaaggataaaatggatctggcgagtaaactgtttaagggcgaccgggtgatatggatcatcttcatgttcctgtgtcttatatcggtggtggaggtgttcagtgcgaccagtacgatcgcttataagaacgcgaatcactgggcgcctatcgtacggcacgccacctttttattgggaggtttcgtcatggtattgctgttgcataatataccgtgtcgcttcttttctgcgtttattatattattgccggtctcgatgttgatgttgatcgtgacgccctttatcggcgtggacgctaatgatgcgcatcgatggctggaaatcatgggaatacagttccagccttcggagttcgggaagctggcttgtgtcgtgtttgtcgctttcttgctcagcaaacgggggaaattaacggagaaccagatctttaagtatatactgattggagtaggactgacctgtgtcttgattctgccggagaacttctctacggcgtttatgttatttggagtttgtttcctgatgatgtttatcggtcagttgccatttggtaagttggcgaagctggcgggtatcttgatgttggcgttggtattgttcttggcgttgcttaagtttacgccggccgctattacccagtatttgccggatcgattcgttacttggcaggggcgtttggagcgtttcttcgacgggcataaggataatttggatgagagtggtacgtataagataaccgatgataattatcaggtaacccatgcgaagatagctattgctaggggaggcgtattaggacagatgcccggacatggccaacagcgtgacttcctgccacaggcgtattcagattttatctatgcgattatcatagaggaactgggtatcgttggggggatctttgtactgttgctttatataatgctgctagtgcgggtcgggatgatcgcccggaaatgtgataaatcattcccgaaattcctagtgttgggatgtgggttgctggtggtagtccaagccttggcgaatatggcggtagccgtgaatttagtgcccgttaccgggcaaccgatgccgttggtgagccgggggggtacgtctacgcttatatcttgtatctatttcgggatcatattgagcgtaagtcgttttggagccaatatcggaaatgaggatgaggaagaggaggatacggagaatccagagaatccttccgacgagccatccggagagacaataaatcaggcggtcgagggagagaaagaagataatccgctatcggctgtcgaaacgataactgtagagtcaaaagtatgagaaagtaccggatcataataagtggtggtggtacgggaggccatatcttcccggccatatctatcgctaatactttcaagaaacgttttccggatgcggaaatcttatttgtgggtgcggaagaccgcatggaaatggataaggttccggcagctggttataaaatcgtaggtttaccagtgagtgggtttgatcgtgcccacttgatgaacaacgtgaaggtcatggctcgtttagcgaaaagcttgcgcttggcgaggaagacgatccgtgagttcaagccagatatagcggtcggcgtgggcggttatgccagtggaccgactttatggatggcggcttcgcaaggtgttcctgcgttgatacaggagcaaaactcgtatgccggtgtgaccaataagttgttggcgaagaaagcgagcaagatttgtgtcgcttacgagggcatggagaagttctttccggcggataagatcgtgattacgggaaatccggtgcgacaggatttggaagaggcgctgagcaagaaagaggaggcgttggcgttcttcgggctttctccggagaaaaaaacgatccttgtggtaggtggtagccttggcgcacggacgattaaccggagtattcaaggggatctggataagttcttcgcctcggatgtacaggttatttggcaaaccggtaggtattattacagcgacgcttccaagcatttgaaggcgtaccggggaatgccggtttggtgctcagactttattacccgtatggattatgcttattcagcggccgatttggtgatatcccgtgcgggggctagttctatctcggagctttgcttattaggaaaaccggtggtcttggtgccttcgccgaatgtggcggaagatcatcagaccaagaatgccttggccttggtccataaggatgccgccgttatgatcgccgataaagacgcggaaaaggatttggtgcctactgccttgaagatagttcatgacgatgaacgtttgcgtacgttgagccgtaatatcgagaccttggcgcaacgccatagcgcagaccgtatcgtggatgagattgttaagattatagataagaaataaggaatatggatataaataaagtgacagcggtgtatttcgtaggtgccgggggcattgggatgagtgccttgatccgttatttcctcgctaagggaaaacgagtgggcggatacgataagaccccttccgatttaaccgaggagttgaaaaaggagggagccgatattcactatgaggataatgtagctttgatcggggaggcgttcaagtcgcccgatgatacgctggtggtttatacgccggcggtcccggagtcgcatacggaattgacctatttccgggcgcacggttttgaggtgatgaagcgggcacgtgtcttgggagagattacgaaaagcagccggggtttatgcgtggcgggaacgcacggcaagacaacgacctcttctatgctggctcatttgctgaaacaatcgccggtggattgcaatgctttcctcggaggaatcctaaagaactacgagagtaatttgatgttgtctgatacgagcgactttaccgtgatcgaggcggatgagttcgatcgttcttttcattggcttactccttatatggcagtgattacttccgcagatccagatcatctggatatttacggtacggcggaggcttaccgggagagtttcgagaaatttacctccttaattcgtcccgatggttgtctactgatcaagaaaggaatcaacgtaacgccccgtttacaggagggtgtcaaggaatatacctattccgttacggaaatagcggacttttacgctgaaaatattcgtatttgcgacggaaatattacctttgacttcgttggtccagaaatccgtattcctgatgtggaattaggtgttcccgtaaaggttaatatagagaacggggtagcggctatggcgatcgcttggttgaacggagtgaaaccggaggatttgaaaaagggtatagctacatttgccggacctcgccgccgtttcgatttccatttgaagactgatcaagtggtattgatcgatgattatgcccatcatccggccgaattgcgacagagtatcttgtcggtgaaggaattatatgcgggtcgtaaggtgacaggtattttccagccgcatctatatacccgtacccgggatttcgctggtgatttcgccgcgagtctctctttattggatgagttgatcttgctggatatctatccggctcgtgaggaaccgattccgggggtgagctctcggatcatttttgataaggtgacgatcccttccaagacgctgtgtaagaaggaagagcttttggacgtggttgccgccgggaaatatgaggtagtattaatggtaggcgccggtaatatcgaccgtttggtggagcctgtaaaagagattttatgtaaacaaataaggaaaccgtgatccgaataatttccatagtagtagccacgttgttgttctgttacatcgtgtttgtgtcgtttttctttcgggaaatacgtcaggactctatttgccaagatctgcaagtcgtggtgaaagacagtctggataaacacttcgtgagcgagagtgaccttgtgtctatactgaagaaagccgggctagatccgatcaagcggtcaatggccgacgtgaatacggatcggatagagacggaattgcttaagaatgagatgatcgcccaagtggaggcgtataagactccttcgggtattatcaagctagaggtcatgcaaaagatgcctatcctccggattatgggcgtaagaggtagttattacgtggataatctgggaaccaccatgccgatcagtcgtcggtatgccgcacatgtgccaattgtgagtggatatgtggaaaaagagcttgcggtgaccgacttatacaaatttgcattatttttgcaagagaatgagttctggaatgaccagattgaacaaatctatgtctatccggataatgatatagaacttattccaagagtgggtaaccaccggatcatgttgggtactttggatgaattcgaagaaaagcttgcgaatttaaagcttttctatgaacaagcgatccctaaagtgggttgggaaaagtacagtatgattaatttaaaatataagaatcagattgtttgtactaaaaaatagatgatatggcatacacagactttatagcagctattgacctaggtacctcccatatggtaggaatggtggggactaagaatgcgacgggcgctctttcaatcatcgcctacgaagttgagaactccggcacctgcatacgaagaggatgtgtatataacgtgaaggagacggcgagtaagataaaacgcttgatcctcaagttggagaataaactgggggggaccaagatcgggcaggtatatgtgggactgggtggccagtcactccgttctatcgagcatacggtttgcaaggtgttgggaacggaaggagtggttacggaggagatcatagactctctttatcaagagtgtaaggattatcgtccggatatgttgaccgttcttgacgtggtttctccttcctattttttagatgataaaccagagtccaacccggtgggcgtgccttgtagccgtatcgaggctcgttataagttgattgttggacgtccttccttgaaattaaatattgtcaatagcatctcggaacaagcgaaaatcgagatcgccggtattctggtgtcaccccttgcgttgggagatgttgtcttgagcgacaatgagaaggacttgggttgcgccttgatcggtttcggtgccggcgtgacgacgatatctgtctataagggtggtaagttggccagcctttccgttgttccctttggaggtaatttgataacaaaagatataaccaatctcagggtcgtagagtctgaggcggaacgcttgaagatcacttatggtagcgcgaaagcggaccgggataatgatatgaccatccaagtgagtttagcggatggaatgggcttgcgtgagattaagctggccgagttgaacggtgtgatcgaggcccgtatggatgagatcttagagaatgtatatgctcgtctggaggctacaggcttgatgagcgttctcggtgctggcatcgtgattacgggtggaggcgccgctttgaagaatttaccggctgttatgagcgaacgcttgaagatggaggttcgctattctgcggttcgcaagggggttgtcgctagtggtgatttagtggtcgccagcaatcccgaatatgcggtagccgtcggcctcttggcgaaaggaactaagaattgcgcgttatatattcctcctaaaccggagcctaagattgagccggtggttgagcctgaaccgatagtggaaccgactccggaaccggaacccgtcaaggagaagccgaagaaagagaagaaaaaaggtcccggcttgttcgggcggttgacaaaaggaatcgatacctttggtaaaaccctcttcgatgacgatgataacgagagtaaataacgtgatctacgaatgtaataaaaccggaagacaatggacgatacaatattaaattttaattatcctacggatactcccaaaatcattaaggtgattggtgttggaggcggtggcggaaacgctgttactcatatgtataaggagggcatacacgatgttacattcgtgttatgtaatacggataatcaagccttgaaccgttcggatgttcctatcaagttgttgctgggacgtgagatcacgcagggattgggcgcgggaaataagccggaacgtgcgatgatggcggccgaggagagtctggacgatcttcgaggtatgttgaacgacggtacgaagatggtatttattaccgccggtatgggtggtggtaccggtacgggtgccgctccggttatcgctcgtatcgcgaaggatatgggaatattgacggtaggtatcgtaaccattcctttcttgttcgagggtgagcgtaagattatacaggccttgaatggtgtggaggagatcgcgaagaacgtggatgccttattggtaatcaataacgagcgtttgcgtgagatttattcggacctttccgtgatgaacgctttcggcaaggccgatgataccttgacgatcgccgccaagagtatcgcggagatcattacgcttccgggtattatcaacctcgacttcgccgatgttaacaccacgatgaaagatggtggtgtcgctttgatgagtaatggttttggtgaaggagaaggacgtgttcgccaagcggtggaagacgctctgaattctccgctattaagcaacaacgacgtaaagaacgccaagaaaatcctgttcaacgtatatttcagcgaggaagccgagttgcgcatggaggagatgaacgacgtgcataactttatgtccgagttcaaccgtgatatagaggttatctggggtactgccgtggataatacattaggtaataaagtgaaaatgacgatcctcgctactggatttacgatggatgatattccattgatcgctgataaacgcaggaatgaagccgctcagatgacggaagaagaattgcgcttagaagaagagcgaatcgagaaagagcgtaaggagcgtgatttgattggtaaatattatggtgcttccgcacaaaaggtgggtcgttttacctctcgtgcgaaagcggtagttttgactcaggaagagttggacgatgatgccttgatcgctttgatagaggataatccgacttataaccgggatccgaagatcgtagcccgtgcccgttccaaagtagcgggagaggatattcaagtatcggctccgacaacggcgaagcaaccggctaaccaatctcgccaagattctcagcgggggggtaaacaagtgatcagtttccgatagttaataatataataaggatatggatttatttgaacaagtcagtgaagacattaaaaacgctatgaaggcgaaagataaagtcgccttggagacattgagaaatgtaaagaaatttttcttggaagcgaaaaccgctccgggagccaatgatacgctgacggatgcggatgccttgaagatcatgcagaagttggtgaaacaagggaaagattccgctacgatttatgtgcaacagggccgtcaagacctagcggatgttgagttggagcaagtaaaagtgattgagaaatatttacctcaacaaatgtctgccgaggaattggagaaagaattgaaagctattatcgctcaagtcggtgccgctggcccgaaagatatgggtaaggtaatgggtgtagcctcaaaagcattggcaggaagagccgaaggacggatgatttccgagacggttaagcgtttacttaattaattgattcatacgaagactgcactaagggcattctgacaattactcgttagaatgcccttggtacggttttctcgtatataccttttcctttgacaatttaattctttagaaaaccatgattacttttacatgttgtctgatagcccttatcgttggatattttatgtatggtaaatttgtcgagcgggtgtttggcgtagatccctcccgggttactcccgctttcacaaaacaagatggtgttgattatatacccttgcctacttggaagattttcatgatccaatttttgaatatagcgggtctgggacctattttcggcgctatcatgggggctaaatttggggtagcttctttcctttggatcgtattgggaagtatatttgcgggcgctacccatgatttcctatcgggaatgctttcgttgcggcatgatggagaaagtcttcctgaattgatcggacggtatctggggaacaactttaagcaatttatgcggggctttacggttatcttgatgatcttggtgggtgctgttttcgtagctgggcctgcagggttgctggctaaactgactccggaatatctagatgctacgttctggattatcgtcgtattcatttattatatactggctactctattacctgttgataagattatcggaaagatctatccattattcgccatcgctttgctatttatggccgtaggtatcttggttatgttatttattaaccagccgccgttacctgagattacggatggacttagtaatatgcatccgggaggcttgcctatttttccgatcatgtttgttagtatcgcttgtggcgctatctctggctttcatgctacccaaagtccattgatggcccgttgcatgaaaagtgagaaatacgcccgtcccgtattttacggagcgatgattaccgaaggtatcgtagccttgatctgggccgccgccgctacgtatttcttccataataacggaatggaggagaacaatgccgctgtcgtagtagacagtatcacaaaagagtggctgggcgctgtcggaggtgtattagcgatactgggtgtgatagcagctccgattacttctggcgatacggctttccgctcggctcgtctgattgtcgcagacttcctgcatatggagcaaaaaacggtggtcaaacgtctgatgatctgtattcccatgtttatcgttgcgataggaatcttattatatagtcaaaaagataaggatggcttcgatatgatctggcgttatttcgcatggagtaaccagacgttggcagtatttaccctatgggccttaaccgtatatttggtacaagcaaagaaattatatgtgataaccttgattcccgccttattcatgacggcggtatgttctacctatatttttgtagctccggaagggtttggtctttcctccggtttttctcaacttttggggctactagttacattgatcgttttcgggatcttcttagtctggaaaagaaagaaagtataaaaaaggctggcttacatttagccagccttttctgtcgttattgttcaagtgaattaaagcacttgtatgccttcctcacgggcttgttcctccccggaaggagtgattaatttataacccttgccgtggatgttgatgatctcgatacccggatcgtctttcaacaatttacgtaatttcgtgatataaacgtccatgctacgagcgttgaaatagttatcgtctacccagattgtcttcaaggcgtagttacgctcaaggatctcatttgcgtgggcgcacaacaaacttaataattcgcattccttcgtagtaagtttcgtaaccttgtcgccgatagccaacgtttgtttttgggtatcgaacaagaagtttcctaacttgtagaaaggaatatctttcatcttcttacctttcacacggcgaaggatagcctcgatacgaagcaatagctcttccatgctaaacggttttgtcaagtagtcatccgcaccgatcttgaatccttccaagatgtcttccttcatagtcttggctgtaaggaagataatagggatatcaggattgatagagcgaatttcttgtgccaaggtgaaaccatctttctttggcatcatgacatccaacacacaaagatcgtatttacctttggtaaaacctttgtatccggcttctccgtcagagaataggtccgttacataccctttagcttgtaagtattctcttaaaagcattcctaaattctcatcgtcttcacaaaagaagatctttagtttttcttccataactaactttttataagaggtaaagtaataataaattttgttccaatgtttccggcaccactttcagcacggatcgtacctttgtggtcctcaataattttgcgtacgtaagcgagtccgaggccgaaccctttcacgtcatgtacgttgcctgtcggtacgcggaagaaacggtcgaatacctttttcagatattctttcttgataccgataccattatcttccacggagatcaacagctttccgttctcgttccaagtgcgtgccatcaatgtaagcggaacttccgggcggcggtatttaaccgcattgtccatcaagttgaacaatacattggtgatatgcatttcatccacatatatatccgattctgtagcttgcaggtctatatccattgtaccgccgtacttctcgacctttaaaacgaaggtgttagccacgttcgctaccaaatcattcgcgtcaatttctttcaatttaagcgctgctttctgtcgttcgaacaaagacatctgtagcactttctcgaccaagaagctcaatcgcttcgtctcgtcgttgattacgccggatatatgcttgaatacgtccggactcttcgttatatccgaatccttcaacatctgagcggcgagcgagatcgtggataccggtgtcttcaactcgtgcgtcatgttgttgataaagtcgtttttcatctcggataacttcttctgacggaatacgatgtaaatcgtgaagacgaaggttatcaacaggatcaatgagaatataaccgatggaacgatgaaagtaatagagcttgagatataatcccctttcgtcggaaaataaactctcaggtagtttagtttcgatgggggatcgttcgggaaaagcacttgggtgatcacgtcagaggcgatcggttgcttttggaattctccgctctggtatactacatttccatctttgttaataacagaaaacacaaacggcaagttcaaaccgttgttaataaattctgtttttaagtaattgttcagctttttaaaatctatacgttcctcgatcggctttagattcgcggtgtataagatgttgtaaatcacctcctctatcagtccaccttggtactggtaacgtctttttagtgtcttctgtaaatctttagatgtgtttacgatgctgttggcagactgccgttttgacaaggaagagagcggctcgaacttatgggcgctaaaactttgcatctctatttgttgaacggttccattagaatccttgatctgtaattggtatttctcatggttgatcacttgtcctaggctttgggcatccggggcattttgatacatgaaatttgtctcatcccggttgatatcatcctcgaggtatttacgggtctcatccaattccagattcttagatacttggcgcaggcttcttttgacagtctcattgaactgttcgctgcgtgtcttaagtataatgctcacatagtttacctgtaggtataataacccggcgaaggcaaaagccataactaccgcaagcaaccaaattgtcgacttcctcatatcaatatctttctcttaatattgcaacaaataacgtatgttttagtttaatatttacacaaaaaaggtaaaaataatccgtttaaaatgttaataatactttgtggacatagaggatgtatgctagctaagcattgaaactccgctgttaatgcgctagttagcgttattttatcctaagttttttatatattatcctacgtaaaaacaagtccggtgcgttctttgttgcgcccggactttataaagtctccacttaggggattaaaatcgatgtcccggaggaggacccatcggacctcttccccgtccgcttctacccggcgttttcacgtcgctggcactggctccgcctttgaagatgctaaaccgatagatgaagtgtaccatgaaataactgcctagcgtgttatattctgagtcttgtatatagctagcggtaacggaacgggagatattgcttcgttgttgcaggatatcgtagatcttgaaacggagcgtcccttggttattctttaagaaagacttggaggctgaggcattccataggacttcgttctgtttgaatccgtccccgtagccagagttggtagaccagttcacgtcactctctatcttgaaattgaggggcagatagattgtcgtgtaaccgccggctccgtaattgaaggtgttttggttattttccttttgcagggagttgctggtggcattgtaacgaatattcccgtttacgcccagatccagataagaggagcggaagtcgataccaccacgttcggacaatatgagattccggttcgtattcttctcctcgttgatatatccgttgctattagcgaacgaggccattgtcatggagttgatggagaatttcttattcttcaagggggtgttcaacatcatacggacgttgccactatagttgccatttacgtttttgtaagtggtggtctttacacctgtctcttggttataagaggtataacttacgatatcgttgatgatataactaccgtttgccatgatcatgaaggcccgttgtttctccggcgtgaactgttggaaacgaataaatacgttgttcgtatagcggggattcaaatccgggttaccgatcgtgatattcgtcgggtccgagatatccgctaccggttgtaattgagtcatgctcggttggctggtacggccattatacatgatacgaagattcgtacgcttatcgaacatatagttgaattgagccatcggggagaggttgaccaccttacgggttatcttggataaggtcgtgtcgccaacgaaattctcgctgctggaataggatgggtccagattcaagccgatcgtgtagttgaactttgcccgttgagacttgaagctcaagctggcccgctggctgataaagttattgcgatagctttggctgtaggcggaatctaatacattatatataccatcagcgtcttggttgtaaacattcttcaaggcttcttgtttccgttggctgatgctataagtggcttggatgaaattattatgcccgatcggttctacccacgatacgtaggcccggtaattgaaacctttgttgtcgtaacgtgagcgctggtcgataatgctattcttcaaggcatcagtctggttgaaataaacgatgtcggaacggttcatgccgtcactgtacgaatcgctattgcctccggaaagggtggcgctgaacacacgccctttgttattcagcttacggctgaaatcgatgctggcatttaggttgtacccgttactttccgagtaattgttggatttgttggtattgaccgtatcccgttcgttatccaaggtggtagcatcactgaaattgtcattcatgctatggctgaggctgaaactcgggcggaagataagttgagtcatcgtgtccggtttccattccaagcgaaagtctacgccaaagttatcgctcttcgtacggctcatcgcctcgctattatcgtaggaggaactatctccgggaagaatattctgccggtcgctcttgctacgagcgtcattgtcggaatgggaataacgagtatttcccccaagagttagtttatccggcttgaattccttgctgaaattcaaacctgcgtttccggaagaggtgataccgctacccgctccgaaacctcctcgtcggcctccaccgcctcccataccggagaacattgttgaggctagatcggaaaagcccatattattcgtgttattcgctccccccatgaacgtgatctggtcattattcacgaaacgattgaccatggcgttgccttcataccgatctttacttccgtatccgccatatgcgttgccaaaccaaccttgcttcatgccgggtttcacggttaggttgatgacggtctcttcctctccatcgtcgaagccagtcatttgggccatatcgctttttttatcaagtacctgtaatttatcgatcatcttggctggaagattcttggaggccactttcgggtcatcggagaagaactcctttccgtccaccattacctttttcacctcttttccattgacggtgatcttgccttcgctatctacctccacaccgggcatctttttcaataaatcctccaaaacggagccttcggttactttataagaatccgcgttgtattccacagtgtcgttgcgaacggtaacctcgggtgccttacctataactacggcttctcccaactcgatcgctccgtcgcttaattcaagtttacctacgtttacggggtttttctttccggtgatttgcaagggttggtacaatggatcgtatccgatgaatgtgatgtgtagtaaataacttcctttctttacgtttttcaaggtaaaactaccattatgggcgctcaccacacctcgtaccatggcactgtcttttacgttcagcaatcgtaccgttgcttgctcgatgggggtatcactaccttgctcaacgacagatccggtaacattaacaccgctttgctgtgcgaaagccatcggtgaaaaaaggatcatcaacaacatcaaaaggcactttcccgatttcataactatatggattacattgtttacaattacgaaaagatagacaaggttcactcaaaatagtttaatataatttttatggatttgatattattaacaatcgtgcaggcctttggatttatggagagtattcttagaacaagaacattataaaaggtaaatagtccttcaatttaacccgcaatattttcaaggattgtgtaatccggtattccacggttttgatagaaacccccaaggcctctgcgatttggggattagattgctctccgaatcggctaagtttaaatgtctcccggtaattctcaggcaattcttcgatcgctttcgtgatattctctgtaagctcgttaacgaaataggtatcaggattctcaaattgatctttaatcttatcataaatcaggctatgtactcgctcatgatacaattgccttttgatcgcattgaggcaacgatgcttaacagccataaaaagataggatttcaaggatatctctacaaataaggaatttcggttttcccatataaataacattagctcctgaataagttcttcggcatcctcatcagaaacatattgggaagcatattcgcatagcggcgaataaaatttgataaacatctgtttaaaagcgtctttacttcctaattgtatttgttcaattaaagtagaatcatccatagcaccttcttcatcctttcttttctgtaagcaaagatatattttatcttggatattcaagattaaaattagggtaaccgcatcgaaatatcacttttaggacatccttatcgcaagatatacttactttaccgatgaagtactacttactttactgataaagtatatatcctatgggaaagtaagtagtaaaagtgactatgcctaaatttacttcacagattttactgttattttctaaggtacttcacatcttagagaagcttctcctgaaaaacttcacagggttgaaagttgtttcctgaaccggttcacagcggcaaaaataccgtttttctttttccatgcaaaacaaccatgaaaaaaccactgcggaggaagcctcgcggctggaggcgcaaagcctccattgagcgatcacatacaagtcagagcttctcggaacctgacaggtgggagcatgtccctgttgctcctatgcggtctcctattgttgtagaagtctatgatcctcgccaacaaatcccttgcgaccaccacgtccggggggcgtttcatcctgtagagccattcctgcttgatgatgccgttgacccgctcggcgatcgcgttgtcggtaggcttgtagtcctccgtcatgctgatcgtggctttaatggcctgtagacgatcaatatattgattacaacaatattgaacgccgcggtcggagtggtggatcagtccatcgaaccctaggggtgacacgtgcgagatacccatgtccagagccgtcacggtattggaggcgactaggctgtcggaaaggacccagcctatgatctcatgcgtgaacgcgtccgtcaggagatgcaggtaggccacgccctcatcggtgtcgatataggtgatgtcggccacccacaattggttgatcctgttgacggtcaatcccttgatcatgttcttgtacttcctgtaaggatggttggagcttgtcgtgtgacggcgcttcccgggcttcagcatcaggtgtgactcgtgcatcagcccgtagaaccagtcccggccacgcatctcgtccggatagagttccttgagcatcaggtacagcttgtacgccccgatgcccggagcctcatgccggatatccctcacggtgtcaagtatctctttctctgacaattccctgcgcatgcgtttctccttgctcacggagtaataaccttctcttgtcttgccaaacagcccgctcaggctaccgatcgattccttgggatgcctgagccgaaggttgtctaccgcttggcgccagctttttttagcaggtcgatgccatattgttcccgaccgatcttaagaagctcatgcagagcctcattgcgcaactctgagcaggccaacgccttgcgtaggcgcaagttctcctcccggagcctctcgctctccgtttggggaccggtcgccttggatgattcggatttctttcgtgccatatatacctgatgctctaactctgtcagatcggacggtaaagatagcgtttttgactcaaaataaccttcccagcgactgaaggtcacgtaatcaaccgaatatttcttacatagcctgtacttggttgagccactctcataatactccttcagcatacggagcttgaactccatgctgtaatttttacgttctcttaacttgtttgacatgttacacacgttcttttaattgttaattacgtgtgaagtaaatctgtatcatgtcaaagtctaacggtcttccataaaaaaaattgatgcggttaccctgggctaaaaatgagaaagttgaaaaaaattgctttttagttaagggtgtgttctttctggattgtcttagttatagaaacagataagaatgaaaactgaaaatagacatattaattttcaagagccggaaggtatgatgcttttacggtatataaaggacacagcttccaatgaggaaaaatcttatattgaagcttggctggaagcggatgaaaataataagaggatcttattacagaccgcccgtatatattatacgaacaatgcgatggaacggatcgctagccgaaatccattgattgcctatgaaaagttggaacaacgattagcaaaacggacccgtttatattggctgaagaggttctctgtcgctgcggcttgtataattgctatcattgggctatcaaccttattttcccatagaaaggctgattctgaatttggagatcctcaaattataacacttcaggcaaatgcgggagtccgtacacgctttaatttaccggatggtactgttgtttatctaaattcgggtagtgttttatcctatccgatgtcttatgaccaaaaagaaagaaaagtatatttatcaggagaagcctattttaaagtcactcacaacgaaaaacaaccttttattgtcagtacttcaggagatcagcatagggttagagttttaggcacggaatttaatatacaagcttatggggatgagaatataatttcgactactttagtgacgggctccgtaaatctcgaggtgaagaataaatcagggaatgtgagtcataggacgttactaccatccgaaaaagcgatttgcaacttggataaagaagaaatttctgtgatgaaaataaacacgatgtatgaaaccgcatggatggatggcaaactgatgttcaaggatacgcctttacctgaggctttgaaaaaattgtcatattactataatgttgaatttgtgattcaggatgcggagattaaaagctattgtttaaccggtattttagataataggttgctatctcagacactagactatttgagaatatcttcaaatattgattatcgtatagaagatatgaagacagatgacagcaaaggtactaaccgtactcgagttatactttggaaaggaaaataaagaaaaatgtataataattaaataatatgggcctatggaataaaagaacaagaatgtagacttggtctatctaaaaaacatatgggaaaatgttaccagcatcttcccatatgaaacaatttgatagaaggtctttaaaccgactaagaaatttattttttaatcttaaatcaattacaaaaatatgatgaataatttatatttccaacttgatggagataaatcaacgtttgtcaggttggtatctaaaatatcaagaattatgaagttgaccttatttcttgtatgtttatcaattagtatgtcatttgctatgacaacaaatgctcaaagcacctcactttcttttaaagcgacagatcaatctataaaaaaagttttggaactgattgaaagtcaaactgatttccacttcttttataatagtaagctggttgatgtcagtcgagtgatatcagttgatatagaggatgaagatctcatttctgtgttggagaatgtgtttaaggattcgagtatcgggtataaggtagtaggtaaggatgtgatcttatccttgaaaaatcttagtcaaggacaagatggaaagaccgtgactggtacggttgtcgatgaaaacggtttacctgttattggtgcgaatatcgtggaaaaaggaactgcgaatgggacgattacggatatagatggaaggttctctattagtgttgggaaaaatgcagtattggttgtttcctttatcggttttaatgtgcaagatgtcccagttgagggtaaatcaaatctgactattgctttaaaagaagatactcaggctttggaagaggtcgtagtagtggggtatggggttagtaagaaatctcatttaacaggttctgttggttctgttaagatggatgaagatgttgttggtcgtcctgctgttgaagtggggcagtctttgtatggaaaagttgcaggtgtgcaggtgataggaggctctggtgaaccaggtagttcatcttcaatacagattagaggtgttaattctatttctgcaagtagtgctcctctcgtagttatagatggagttgctgttcctgattatgatatgaatttgatcaataatgctgatgttgagtctatcgaaattttaaaagatgcttcttctgcggctatttatggatctcgtggtgcgaatggtgttgttttgattacaaccaagagtggaaaaacagaaaaaccacgagtaaatattaattacttgtttggtgttcaaaaattgttaaagaaaattgatgtcatgaatagtcgggagtacgcagaggcttatatggatgccgcacaaaatggttgggttgatagtggtggtgatcctaacgcacctaatacaatagaggcgcgtggtgcatataaatatacatggcctgaagcatttgagcatcctgaaagtttatatgatattgattggcaagatgtcgtatttgatgcggcaccaatgcataaattggatgctaatatttcgggtaaatcggaaaagtcagattacttgatatcggctggatatgtcaatcaagcaggaattttattagactctgattataaaaagtactcattaagtcttaaattgaatactcatataaataaatatttggatgtgggtggcaatatgagtcttaattatggagatcaaaaagaggtctattggagaacagcagagtgggcagtccaatatccttctgttttccctgtatatgcggagaatggtcttcttggttgtaattcatatctccctggtttcgaaaaatataatacaatcctttttagaccgaatatgggccatcctctttatatgaaaaataatgatgcaaatcggcaaattctaaatacgataggaagtgcttatgtgtcattaaatttattacctggactgaagtttaaatcttcttttaattattatttaaaaaggaatgattataataattatgaggcaaaagatcatgacttaggagaggcttattatactccaggacaaatgacagttgatcaagctagaaagtggaattatacatttcaggatctattgacgtatgataaatcttggggtaatcatgaattttcattcttgttaggatttgaatttaataaaaatgactattataagactagtcagtcaagaagggactatgataatgatttattgcatgcgttaagtgcgggaaagaccgttttgtcttcaagtgatgtaatcacaaagaatacattgatgtcttattttgcaagagtaaactataactataaaggccgatatatgctttctgcagctttccgtcgtgacggctcctctcgttttgctccgaataataaatggggaaattttccctctatttctttaggatggttagtgacggaagaggattttatgaaaaaaatggattggattaatatgttaaaattgcgagttagttatggattgacaggaaatgaccattttcaagattatgtttgggtggcgaaattaaatcaatctaaaattgcttttggaaataatttaacaacttcatattatccatccaatataactaatcctgatttgaaatgggaacgtacacaacagttaaatgtgggattagactggggagtgttgaagagtcgtatacaagtaggattagattattattattcgacatctgatggactgttgttgaatgttccagttcctgctataacaggttattcttctatatttacaaatatcggtaaattggagaataaaggtattgaatttaatataactactcaaaatattgacaataaagatttttcatggagtacgaatttcaatatatcaaaaaataaaaataagattcttgaattagggccaagtggtgcttctatgatctttactccaagtagttttggtggaatgcaaaaaattaatgaggttggtcactctgtgttcaatttttatggataccaatatgatggtgtttatatgagccaaaaagagatcgatgctgatccagcgcattataaaactgcaagacctggagatggtcgatacgtagatgtaaataagaatggtgtattagatgcaggtgatagaactcttattggagatcctaatccgaaatttatttggggatttacaaataactttaagtataaagattttgatttgagttttttgttccagggtgctcatgattttgcgatatatgatgataatgctcatcgttcgttgatgtatcatgaaggtcgaaattttttgaaagaagttacaaatagatggcgttcggaggaaaatcctggtgatggtgagcattacagattgtctgtagacttaggagaatatgaaaagagaggatcaagtttgtggattgaccggacatcttatattaggttgaagagtttaacttttggttatacacttccaaaaaatatttcgaaaatagcaagtttgcaatttgtgagattttattttaatgccttgaacttatttacgataactggtactgatgtttgggatcctgagtcgtttagaggggatgcctcagatgcttctgcaagaggtgtgatgggaaatatatatccatcttctaaagttttttcttttggtgttaatgttggattttaattcataatgtgatgaaaaagtatattttgttaatcgtaatggctgtcatggtctcttgtagtgaccagttagagctttatcccgagacaaatttaacagaaggtaattattataataccgaagaagaattgtcgttggcggctaatgatgcttataggcaattatgtcggatctataatgcgaatgggctacctgatttgtttggagaacgattctctgataatgtatgtgtgatttttacagatggaggaaatacgtatacggaagatatagtgcttcataaaattaaatcagataatggaacaatactatcagcgtggcgaactgcttataatggcatctcaataattaacgatgtattatatcggttggaaaatacatctgtctcttttacgtctgatgagtttttgaatagaattaaagcagaacttatttttgttaggtcattgatatattttaatttgattcaagcgtttggtgatgtacctttcttattaaaacctgttactgtttctgagagttattcttatttgcgtgaagataaaaatcaaatatattctcagattatagcagatttactgttttgtaaggaatatttacctaagtcatatgaaggtaaggatgttggcagaataacaacttatgcagcatcttctattttggctaaaatttatttgattcgtggggataaagattctgctaaaatagaattaaaacgaattattgattctggaagatatagtttggatgctaataatgatggaaaagttgatgttgaagattatgcgtatttgtttgccccatctacaaaaaattgtaaagagtctattctggaggctcaatttttgtcgggcgtagacaatgtaaatgcggaacatcaaaatcaatatactccttttctttggtcttttcatttacctggttcttctgacacttttagaggaggaggtaaaaatactccaagtaaagatcttttggcagaatatgaagaaaatgatcctcgtatgaatctctctattgtcccaggttatcaagatgaaggtgctaatatttgggttgatcatccttatacttgcaagttctatgatcctgattggcaaaaccctggacaaaactttgagattattcgttatgctgatattttattattgtattcggagttgacaggagatgcaacttatttgaatcaagttcgtgctagagcaggacttcctttatatggaagtgattcgtatccaaaaaagtataataatttggcgttggctgtagagcatgagagacgagttgaattggcttttgagttccatcgtttttttgatttggtaaggactaaccgggcgttagaggtatttaatgcaaagggaatcagtttatctgaaaatagtctgttatttcctatacctttggttgaaaaggatattaatccagaattaactcagaatccaggttattaataatataagaatattatgagaaatacatgttttaattcacttttgatatttagtggagttttgggctctggaaacttgttatttgctcaagagaaacccaatatcgtggtgttcatagcggatgatgcaggcatggactttggttgttatggtaatttggcaattaaaactccgaatatagacagaattgcaaagcagggagtccgttttcaaaatgcgtttttgacatcaccgcagtccagtccatctagaaccagtatgatgacaggtatgtttgcccatacgattgggacagaggatttgcatatgccgatcgatgaatcgactcgtatgatgccctcctattttaaggaggcaggatattttacgggctctatgttgaaaactcattggggttccaatggggataagcagtttgatcggatgatctcgggaacgtatcttcccaatggtggggatttgtccgaagagacctttcggaattacgagcgatttattgatgatagtgctgatcatccgttttttctttgggtaggattccatgattgccaccgtccttatttccgtgatgtctgccctcaggagaatgatccttcaagagtgaaggttcctccttatttggtggatggagcggatacacggcgggatctggcggattattatgatgagattactcgtatggacgggcatataggtcggatgatctccgtcttggagaagaaaaagctgatggagaataccattattgtctttttgagtgataacggaatgccattcccccgttgtaagggttctttatatgattcaggcatacagactcctctggtgtttatgtggaggggtatgatccctgagaataaggtgcattctaatgggttggtcagcacggtggatttggcggctacgttgttggattttgctggagtacggatggatgagtgcgtttatagtaagagctttcgcaagctgttgtttgatccgtcattgaggggacgtgattatatcttctcggagcggaattggcatgacacggacgagtatattcgttgtatccgcacggagaatatcaaactgatctataatgcgtattacgatattccgcatggtacggcaatggatttaagctctagtttaagctggtttgagttgaaacaaaatcagcgaaatgggactttgaaacctgaacagtctcagatattcgtagctccaagggctatggtcgagatctatgatttaaagaaagatcccaatgagttggagaatgtggccgatcgtctcccttatgcggtagactgtaagaagttggcgaaactacttgtggaatggcagaaagagacaaaggatcatccttggtggaagcggcgtagaccagatcagaatgacagggtgacaggattccctatatttcctagatctgagacgttttgggctgattaatacctttgaatgggttgtgtgaaagagagctttgtctgttttaatagaaaggggtatgccgaaaagcatactcctttttatgagggattattatggtaagcatccgataaggtatacattgtaaattcataaaacgacaagctcttcttgtcagcgaatataaagttgataggaagagtttgccattctagtgtatctttgaaacaaaattcatgttggtgaattttaataaaaaatcattatgagaaaatgtagtgtattttatggtactttgttagcgttagtattggtgagccttggtgtaaaggctgataacaatggaaatgaaaacgtgggacattcgggaaagacatccgaatatacagttgcggcttatatttggccttcctgtcatgatgacccgatgggacgggaagtattatggccagagaagacgggtgagtgggagatcatcaagaagggtaatccccggtttccgggtcattaccagcctaagattcccttatggggttatgagttggataacgatcccaaggtgatggggcgttggatcgaggctgccacggaccatggggtaaacacgtttatttttgattggtattggttcaacaacggaccgtttttggagggatgtttgaatgatggtttcctgaaagccaagaacaaccagaagatgaatttctatattatgtgggccgatcacgatgtggctcgtaattactggaatgtacatcgttataaggaggataactctcgtctgtggaatggggcgatcgattggcccaatttcaagatcatcgtgaagcgcattattgatcaatatttcaaacgccccaattattataagataaatggggaacctgtcttctctgtttttagcacggacaatttgatcaaaacattcggttcattggaggaaactcgcaaaggtttggactatttcagggaggaagttaagaaagctggtttccccggattgcatgttcaattaatgacgggtggtgtaccgaatgctgatttcttgaagcaaatagagatgttaggtattaatagcttaactttgtataattggggaggcccacatccggaggattacattcaatggggaaaagaggctttcgagcgtttggagaaatggagcgaagccgtttctatcccttatttccccaacgcatctataggttgggacgatacgccacgtttcccgcataaaacacagaaggacgtggtgcattttaatcaatccccagaggctttcgccgctttcttgcaaaaggcgaaagagtattgtgacaggcatcctgaacagcctaaactaatcacggtttacgcttggaatgaatgggtggaaggagcttacctcttaccggatgtgaagtatggtttcggctatttgaatgcggtgaaggatgtgtttgttaatgggaaatatcaagcttattaatgcgagttcggaataagctatagcctgaaaaaatgaatcggcagtttgaaaaagttgccgatttgttctgtttgtctgacacaggacttcattcggttagtttggaatttcgttgattaccttctgattccgatccacgtactagatctcctttaccgatgaagtattacttaatttactgatgaagtatatatcttatggggaagtaggtagtaaaagtcaaacggtctcctgtaaaaaatgatgcggttaccctgcttttcaagaggaaataacctcttcttatttttttattttatatttgttcggtcaatatgtgctagaagagatggatgtagaacggatatacctagaacgattacgaagcggttcatacagagactttacgaaactgtatgaatcatacgcttcacgcctatatgcgttcgcattgcacttgactcattctgatgctcttgcaaaagatattgtacaagagacttttatcaaagtgtgggtgcggagagaacaaattgatttagatatgtctttcagtgctttcctatttacgatggccaagaaccaattattgaatgagtttcgtaggcaggcaaatagtccacttttttgggaagatgttgtactaaatgagtctggagatggagaggaaacagcgattgaacgtaaattatcttttgaggaatttaaccatagactggaaatagcgaaacaaaagttgacacctcgccaacgagaactgtttgagttaaataaggaacaaggtataactataacagaaatagcggctaaagcctttatttcagaacaatctgtgcgtaaccagttatcgcaagccttacatgttttaagaaaggagctcggtaagtatgctttgctgttctctcttttctttatcggataaataaaattgaaaaacaatattcttatgttttataacatctaaaaaggcatgttataaattaacggctcatgtgtataccttataaaaaggatattatgcaggagtcacatacatattatttgctctcaaagtacatggatcagacgatctctacggaagagttgaaaacactacggcttttggttaatttgtctgatgatgatgaattatcgttgtcattgtctcatttatgggaaaatgggcgaccctttgaagaggttgatgagagaatcatacgagatatgttcagtgagattcaaaatcgaacgagaaaagaacgattcgttatggtgtttaggaaactggctcgtatcgccgcaatactattaatacctttattaagtatattgtctggttatttatatttcaatccagtcgatcagaagggtagcattggcaatttagtggttcatgccgatagaggggaaagatcgggggtgactttaccggatggaacacaagtaaaactaaatgcggaatcgagcttaagttacactcacgatttcggtcgagagcttcgacaagttaatttagagggagaggcctattttgaggtgactcggaatgaggataaacctttcgtggtacatactgaatatctggatatagaagtgttgggcacaagttttaatgtgtattcgtatgagcgggagaatgtcatggaaatggccttgatatcgggacggatcaagatacagacttgttcagacccttctcgtgtcgtttatctaaaaccaaatgaaaaagcattgttcaataaagaatcgggtattataaccgtggagaaaacagataatcgatttgaaacggcgtggttaagaggagacctcgtttttcgatcaacgaaattaagtgatgtcttggccaaactagagcgtagatatggcgtgaatatccatttgaatgatttttctttagcgaatgacttatttaccggaaattttgatagtgaatatatcgtagatgtaatggaccttttagagaggcattatgactttacatatgatatacgaggagatgatatctttatacatccttgagcgagtgaaaataaaatgtataaccttaaatcagttcttatgcgacaagattcttcataataaaaacggaaccgaaaaatggtcgagattttccggttccccaattaatactccatttacgagaatggcgatcaagccataaaacggattgtatcaattttaaaaaataatatatgttcaaaagtagaaaaaatcaatgtagctatataatttttttggctctatttctgttttttaatcctattttggtattagctcagacaggaagtgtcactctttccatgaagaatgctacattaaagcaattttttgaggctgtagagaagcaaaccacatatatattctcttatcgggatgctatagtggaaggaaagaaagaggtaactttaaacgtgacgaatcagccgattcggcgtttgttagatgatgtactgcatcaaagagacttgcaatatacgatgacagggcattcaattgtcgtaactttaaagactgccggtaatgtaaagctggtatctggtactgtcgtggatagtaacggtgaaccgattatcggagcgaatgttgttgagaaagggactacgaatggaacggtaacggatatttcgggaaatttctcattaaatataaatgatagcggtattttacaggtctcgtatattgggtttaatactcaagatgtagctgtgaacggaaaatcaagtttaatgataaacttgaaggaagatactcaaaaactggatgaggtagtcgttgttggttatggcgtgcagaaaaagtcgaatgtaacgggatctgtggcttctattaagacggatgattttaatgatttaaatatggatgtgtcgcatgttattcaaggccgtgtggcaggtgtcaatgtttccaatgggaatattatcattcgtggagcggcttctatcaatggcgcagatccgttgtggatcgtggatggagtgccgggtagcgctcctaattttaatgatatagaatctatcgagatcttgaaggatgcggcttcgactgctatttacggtgcccggggagcaggaggtgtgatccttgttaccactaaaaagggaaagatagggaaactttctattaatgcgagagtaaactttggaatagagactccgatcgatttgccggatatgctgcataccgcggactttattgaccggaaattggcggcaggcttccctaataatcccaattccggctgggataatcccgcttcgctaccagatacagactgggaagatctggtttggcgtaatgcttttaggcaaaactattttttatagatgacgggtggtaatgagaaaactacatttaatatgtctgcggagttctacaagaatcagtttatcgaacgttattcatttgaggatgcgggtaatttccgtgtggctagccagacaaatataagtaaacgcgtgaaattttccgagatcatgactgttggttttaataatacggatccccatttgtatgggcagacgaataatgattatgtttattaccgccaagttcctacgatggtgccttatgataataccaacgaagctggtggaggttggggaaaacatccggcaggtggttactacgagggacctaatcatgtggctacactaatgtctcatcatgagaatgaacgtaggttttgggcccgggcaaatgcgattttggattgggagattatcaatgatttaaaattccaagcgaatttctctgccaattttgactcccatgcgaataatttgttcttagagtcatggaatttgggatctttatctcaacaggattattactcgaaagattatggctccggttatgatttacgtatgttatatacattgacctatgaccatacttttggggagaaacactatgtaaaaggtttggttggctacgaggcttatcgggcgacggcttcttcggcaggtggttggaaaaacggctttttggttcagccttcggatgatattagtttaggtacgggagataaagatgtatccggaacgaaaacggaaggtcgtagtttatcccagttcgctcgtgtaaactatgcttatgatgacaggtatttgctagaggctagtattcgtcgggatggttatgataactttggtccagagaatcggtttggtgtgtttccttctgcttctgtcggttggaatgtgggaaaagagagcttcgtaaaggataatataacatggatgtctcaattgaaattgagaggaagttatggtaaaattggtaacaatacaattcctcaattcttgtatgaaccttcttttacgaataattatctatattattcatatgataggcaaaatacgcagagaggattctggtattcaaatgttgcgaatgctacgattaaatgggaagacgtggcccaatggaatataggtgttgacgcaagttttctggataatcgcttgaatacgacaatcgagtattatgataagaaaacttccgatatgttatattcagtaggtgtgccaccttctgccggaccttcttcggaaccatttagcgagacttcttcttatcgggctaatatcggaaagataagcaatagaggtttcgaatggatggttcaatggagggattcctataaagatttcaggtatgacgtggcttttacgttgtctaccaacaagaacaaagtggtaaagttaagtgaccaagtgaatccgatcatttgggctggaagcgatgcgactttgaatagttctatttatcgtacggaaaatggacaaccgatgggacagatgtatggatatgtcgtggatggtattattcaagaccaagcggaaatcgatgccttaaacgctcaatctccggatggattgtaccaacaagcaggtacggctccgggtgatttgaaatataaggatttaaatggagacggaaaggtgacgaatgaggataagacatatatcggtaatccttggccggatttgatgtatggattgaatataaatttgtcatggaaaggccttgatttaagtatgggctggttaggaaacgcaggtgttgatgtctttaatagcgctaagctttatgaaagaagtttctatggcgactataatacgacttataaggtatatgaggcgtggagtccgacgaaccgggctacttcacatcctcgagtaacgaaagaggacccgaatggaaacttcaagaatgtctcctcttattttgtggaggatggttctttctttaaattgaagaatttacatttcggctataatttaccgaaatcaatactttctcatttgaagatagaaggtttgaagttttatattaattgtgataatttatttattatcacaaagtttcaaggagatcctgaattgggtggtggatatttggaacgaaatatgtattctgtgaaacgggctccatccacccgcaccattatgggcggtttaagtttaaccctctaaattaataggaagatgaagaaattagttatattattagctgctgcgttaacttttaatagttgttcggatagttttctggatttatcaaatcccagtgcgttatctccaagtgtctaccctaaatctatggcggatatggagactatcgtaacatcagtttatgcgaatatggtcgctgtgcctttgtatggaaagagggttatggcgaaagggacattctgtgtggatcatacggtagatatggcttggactggtgacgccaactggaaccagttggcgaccaatcaagtgacttctgataatgcttacattgggacgttatggattggttattataaaatgatttcttgtgcgaataccgtattggagcaattggaaagaatcgacaaggagaagtttacagatgcggatttagtaaggctttcgcagatgaagggagaagctttgttttggagaggttgggcacaccaacagctagtagcgttttttggagagggatatccttgcaacggggagggcgatagaaaaggtgtacctgttcgtttacaggtagcatcgactccggatatgctaaatatagaacgtagcacggtggccgaggtttacgatcagatcttgaaagattatgaggcagccaaacttttgctacctgctgtatgggaagagagggcggactatccacgtccaacctctgttgccgttactagttacatcgggcaagcgaatttgtatatgggtaattatgatgcggcaaagaaagcgttgaaagaggttattgattcttccggaaaagaattgctccctttcaatgaatatgcgaagatgtttaatgaggatcaggagaaatttaatagagaatcgatcttagagattaatttccgtaatggggatacttccggatatttttggtatggagaaggttctcaatatggattgatcgctgccttatgtttccagaacgcaagtggagatgttgaggcggccggttggggtaatattttctttcatgatgcgaatattaaacgttttaatggagatcctcgtttggatatcgccgctttgcgtccgggaactcctgttattatgaatggacagcagacgcaggttctgaaatataaggatacggaggctgacattcaaggttggagcatgcgaaaatacaatccgttgaaaagtacggtgaatgagttgaatttaggggttggtattaatatgtatttgatgcgtttggcggatgtatatttgatgtatgcggaagcttgtcaggctacgggagatgaggtaaatgcccggaactatatgaatctggtaagaagaagagcttataatggagatagttcccatgatataacggctagtggagaagctttgagagatgcgattcgggaggaacgtttcatggagttctgcggtgagggcgtacaacattggcaagatgtttgccgctggaaggtcttggatgaggagattagccgttggtatggaaagacacgtgttggtaatccgcattatgatgcgaaagatttgtatttcccgatacccaaggttgaaatggagaataatccgaatatgacacaaagcataggttacgagaacgagtagatataacttgttgaaaagttcatcaaagaaaaggaataggatggttctcttgggatcgctaatcctattctttttttattcctttatgatcatattaaatcttattgaataatgaagatgatagatgtgtcgaaagtaagagtctttcgggggagtctctttgtattgtttatgctctttatgcggataggttgggcctcaaatgatgatagcacctataatatcgtggattttggagctaaaggagatggaataacagacaatacccagttcatcaacaggacaatagaagcttgtaccttgagagggggaggaacggttatcattccggagggaacgtttttgacaggaagtattctgctgagaagtaaagtaaacttatttttagaaagtaatgccgtagtgaaaggcataaataatctggaaaagtaccgttctatatccgatcttaatcaagatgagacttattataaagtaaaaccccggaattggaacaaggcattgcttttaggagatcaagttgaagatgtgtcaattacaggagagggggtaatcgatggtgcccatattcaagataaaaaaggtgaagaagggatgagaggccctcatattctctttttgtcgagatcgaaagggattaagatatcgggagttaaactacgaagagcatcgaactatgcttttatgagttatgatattgaaagggcttctttcgataatcttttagtggaggaaggatgggatgggattcatattcgtggcggaaaagatatccgtatccgaaattgccgttttaatacgggtgatgatgctgttgcgggtgggctatggaagaatgtggtaatagagaattgttatatgaactcatcgtgcaatgggataaggttgataatgccggctactggtttaaagatcgttgattgtgaatttagaggtccgggaaaatatccacatcggacttccggtgagcaaaaacgtaggaatatgctttctggtatattgctccaaccgggcgcatggttccctgcgtttggggaaataaaggatatattgatatctagctgttcttttgatcaattggataatccgtttctagtcacattgaatgaggggaaccggggagagcggatctgtctggagcatataagaggtacacgtttaatgaaagcggccgcctcggtagagagttggggagatagtagtttgaaagatgtccggctttcggatgtttccttatcgtatgttggaaacaaaggtcaagaaatagtaggacgtactccctcgaagccattgaccgattatcgtgcgctcccttgctgggggctttaccttcataatttagatcgagtgattttacggaatgttcgattagtttgtgagagtgggaaagttagcccagcctcatgcttcgataatgtggggtccgtggagatttataatgtaagtttttaatcttaaaaagaattagtatgcgaaaataccttttgttttgtctagctttttgtgtattgggttgtttggctcaagatttgatcgtccgtccgaacgatcctattatttataagaaagagggcggtgcctttttatggctgggggatacggcttgggagttatttcatgtattggataaggaggagatcgttcactatctggataaccggcaagaaaagggctttacggtaatacaggctgttatcttatctgaactggatggtttggataaaccgaatgtgtacggatatttgcccttggttgataagaaccctacccaaatcacggaaggatactttgagttagtggatttcgtgattcgagaggctggaaaacgaggactgtatattgggcttttacctacttgggcgagtaatgtggtagagaaagacggaaatccggctttgtttaacccagataatgcgtatacgtacgggaaaatactgggaacccggtataaaaacgaagctgtaatatggattcttggtggcgatagaaatgtagttacggataaggagttcgagatctggcaatctatagcgaaaggaattcaggagggaaatggaggaacacaactaatgtcctatcatccgacgggagagatttcctcgcattattggttccacaatgagtcttggctatcattcaatattctccaaagcgggcattaccgccggatggatccggtatatcgtttttcgggtatgtatgctcaattgaacccgattaaaccgtttgtaaacgcggaaccttcatacgaggacataccggttcgtttctgggaatattttgattatgctaagttcgggaagaaaaaggaggacataataggtgataacggattgattaaggatacgacttattttacggatggaatttacgatgactatgatattcgtatgcaggcttattggacttatttctctggagctgccggatatacatatgggaataacgctatttggcaaatgtataagccgggtggtaaatatcatgtaccatgccttacgttttgggatggtgcgttggataggccgggagccgaatgtatgcgctatgtaaagtctttgtttacgatgtatccgttagatcgtttccgtccggatctatccgtcctgttcggaattaattacaatgacgcaagctatatcactcccgttttagcaaaagataagacttttattttagtttatttgagtcaagggcaggatgtaagaatacaaatgagtaaattgcgatctttaggtaaagcttattggttcaatccgaggaatggggcgagaaccttgatcggaccggtcgagaataagggaattcgtacattcaatgcgcccggagaagcgggagagaggggaaatgattggatcttaattttggaggcggatgataggtagacgatgtataaattttaaataataaaagtcattatgaagaagatcaatgttttgctgttagcctttttgctgttaagtttttgggcgaatgcccagcagtatccttttaacgggttggatatgaatatgggaaacctttctcgtttgtcgaatgcgcagagtcgttcgatcagtccggagaattttacgggggagaaagggaaaggagcgatggctgatcccgtgagagataaggatgtccggaataaggcgaatgcggccggcccagcgaaagatttggggaaaggctggaaagtaaatccttttattatcgtgaaaccgggggagacagttaccatcgcggagattgatggcccgggggctatccagcagatatggatgactcccactggcaactggcgattctcgatactccgtatgtattgggacgacgagaaagagccttcggttgaatgtccggtcggggatttcttcgccagtgcttttaatgagtatgcccaactttcctcgttggcggtctgtgtaaatcccgggagcgctttcaattgctactggaagatgccgttccgtaagaaagcacgtataacgttggagaatattaataatgcggaagagatgcgtttgtattaccagattaattataccttgacggaagtgccggaggatgagggatatttccatgcgcagttccgccgttccaacccgacacaaggctctatccatacgttggtggatggaatcaagggaaagggacaatatgtcggaacttatttagcttggcgtgtcaatgataactgttggtggggtgaaggagagatcaagttctatatggatggcgacaaggaatacccgacaatctgtggaacaggtacggaggattatttctgcggttcgtataacttcgagaatcagaaaacacatcaataccaagaattcaccactccttatgcgggaatgcaccaagtgatccgtccggatggcctatatcgggctgttacggcgttcggcttgtatcgctggcatatcttggacccggttcgttttgaaaaggatctgaaggttacgattcaagatttgggttggcggcacgacggtaggtataataatcaaaagtcggatatctcatcgactactttctggtatcaggtggaaccacacgctaaattcccggcattgcccagtaaggatgatttggagattccgagatggtaaatggcctgtggtaagatgttaaatgttatttccgattaaacctttcctttttatcgatgtctattctttcgaagcgcttcataaacaggtaatttataataaaagtaataagtagtagtttatgaaaaaggtaataggattgtgtttggttgtattgttgagttcaacttctgtgttcgctcgtgagaacaggcgtatggacaagcgtaagatggatccgtccgcacgttgcgagaagatgatcgccgacttgaagctggatgagaaacaagcggtggagttccgtaaacttcaaaaagagtatatggaaaaggctcaaaaagaacgtgaggcgatgaaggctgagcgtgagaagcaacgggaaaagatgttggccatgcgtgaggataagaacgcccagatgaaaaaaatattgacggaggaacaatacaaacaatatctggaaaaacagcagcctaaagggaataaacatggcagaaaacatctaggtaacggacgtagataaagaagtctatagatagataaaatggccggggtagcgattatcccggccattttagttctaatcggctgcttcaaccacataccaagtatatccgttggcagggattttaaccgtaagctccaccgtatagtcccggttcagtttgtaggtgacaggcttttgctctttttcccggatgcgggctgtttgtgtcaggccggtataatagagtggaatatggatcgtacgggtgatctcttgatgggtcggattgaagaacatggctagacctttctccttcttgtgaggattgacgtgtatgaacccgtcccagtctcgtgcgtccggccggcgtaagtggatcatatcgctgttgagtatatcgcggtatttcttataccattgaataacctcggttacggccgcttgggtttccggggtatcatataggcgtggccctcgatagcaagcttggacaccagctccgtaattttgcatcatatgtgttttgtattcgaacaagtgttcgtggaggggctccaaggtggcggcctctcctcctccttgatactccacgagaggaacgaagctccagcatgccgaagccatccgatcccatgtaccatcataattcaattggcgggcatggatgatctgccggtcccggggaagcgaccagttggcttcacggtaaccaatgcctgtcttggtagacccgttcaagaaatagaaatcgggaacattgatataaatgccattctcgcacatccaacgatagagatcggttatcttatggaactgattccattgggaatcttccagccctttatgataggtatggtgggtggaggcgcatacgtcgccgggataggagccgtcgtgctcgaagcaacgcatgcccgtacgctcgaagaaggttcgtatatgatggaaatactcatatccccaatcgctgcaaaggcagggagcgctaccgaaacgcatcccccctcgttttcctgtcttgggattgataacatctacctcgtcgctgatccaacggcttgataagagggagtaacaccctaactctacacctttgttgcgggcgtaatccaccaaagatttatatttgacgatattttcttctgagatatcctcggcgttcaatccggatccaaagctgatgataaccatctcgtatccaacggtagcgcattgattgatagcggtacgaataacatccggatcggaagaggtaaggtgcatgaagatcggattctccgtagcccatggagctaccgtataatgtaagcgtcgtttaaacaaacccttccgttcccgatcatcgctgtcgaacggcatctcgtatacgctaaaggatttgaatttctggcccgccgctagggtataatcgggacctagtttgggcgatacgtctaatatacaaggcgtgagcaaaggataattgcgttgggaggtatattccggatcggccacccatttctctgtgatatcggtttcccgctcggtaaactctccgccacaagcatagtcgctttctacatgtatgttcggaagcctgaatttagagggatctccaccgccgggcgactccggttcggcgaatgccagatattccaattggaaggcatcgatatctatggactgcggggtattgttggtaacctccatacttttccggataactgggatgtgatcgtataagtcgtaatggagttctacggtgacaccttctgtttctttctctcctttcaatacgaaagtcagtcttttccctgtgggtacgttcttattcagtgcccagcggcttctggcccatttgatatcttcctgtagctcttctatgcggaaatcctcaatgagaaaagaaccggggcgagtagtcatctggtcgacccattccatttggaagtatccgcgctcgggctggccggccagcccgccaagttcccaacgtttcccgtcaatcgtcaaactaccttcgctacttacggcacgaagcatactttctccggtcatccggtttaagatatcgagagtggaaagattgggtaagacacggaacatacgtgctaccattccgtttgacaataagatgcttttgccatctggagtcgcatatatgccggcttttgatcgtgagggttgtaaaagccagtcgaaagaggtgttttccaaaggaagcccttgttggggtaattgcttgattttatcaagtaatttcttctccgtaccggatgatacttccggccctttcccttgatagctcgtggagacgatcgaggggatgatctccatatactctatttggggcgtgatccataaggcatgatctccgctaggtccatcgtcggtaggctctacgataagatccaatatctttatgccattcagggggatatcgattgttttcggggcatcgccaagtttgacgataccgctgttataaagctccttgtcatctcctttcaagataaataaggccgagcccggatgtacttttccgtctttaccttctagaccaacaaatgtcttggcgttttttcgggtatcgaaatacattttcgttccgtcaacaaaagggataaccgtgaggcttttatccgtataatcgatatgtgaatcggcgatcccgacctgcgcttgaaagcgtgacgcattcttgtgtaaatcgatcttgatatgacttttagcttgtaccccgatcacgtcatcatacgtttttccttgtatagaggcgggctcgttggtaactgatttccctttgacggcgccaccgtaagtttggtaggatttatttaggtccatgtccataagccggatctcgttctggcccatggcgtagagaccggcaaatcccgaaaggatagctgtaaagataagtttattcataaaatccagtgataaaagagggtgttatcaatgataaaaataaggtgcttcaaaaagacttcttttgaaacaccttatttggtttataatctagcttcgttctattataatgtcgtaagttttaaatttcgccaaagaaccttgatgcctccaccgtcgtgaatctgaagggcgatgcggcctttacccgctccgatcttctcatcattcaagtttaccatttcctgtccgttcagccaagtctgtacgttgtcgccttgtactttgatacgcatcgtgttccaatcgccttctttcaagatattctctttctcatccggaatctgaaccaaccagccacgtccgtacgactcatagataccacctgtatcgtggcccttcggagctacttctacctgccagccgtttactttcacgccttcctctacgaaagagcggatgaatacgccggagtttccgtcagcctcttgcttaaactctacggtcagatcaaaatcatcataataatcacgggtagcgagataaccgtattgcttgtcgggaccactttcgcaaaccaataaaccgtcttttacgtaccatttctccgtaccgtatggttcccatcccgtcaaatccacgccgttgaacaagttcacttccttaccggccttacggggaagttccttgatcttcaagttacggaaagatgcgggataaccatgatcttgcaagcaaagcacaccttttttcgccaatccgtattccggcgcgttggcccatttgccgctatttttcttagcgtgccaatcgtctgtccatgcctcgaactctaggatcttttgtccgttcaaccaatgttccacatgtccgttatcgaatacgatcttggagttgttccattcgccttgcggattcaccttcatcttggatttatccggcaaatgcatcgcataatccacacctaatttctgccactcttccaatgggtccgggaagttcggctcgtcgatcaattgatactccggccccgttacgtaaggaacagcgaattggggacgctctaccacatggtacaacataccgctattgccacccttggacaatttccagtcccaagaaagctcgaagttctcatactctttatcggttacgatgtagccactagcgtcgctgccatctcctttggcttgtatacaaccatccactacatgccaaggctgtgtcaatgtagtcccgttgtaatctttccaaccatccaatgtctttccatcaaaaagcagaacccatccgtcagcgatttcctcgggagtaagtgtgttttgttcttgactggcacaagaggaaaacaaggccagcgataccgcacaagaggctaacaagcttgtggcggctgtttttttcattacagattccatgtaaataaagaatttaggttgataaattgtaactgaatggcaaatttacgtaaatatctttgatatctctctctgttggaggaaaaacgtttctctccctaggaaatacttctccaagagcctatatattctttgtcgaataagctctatttcttaatttggcggcgctgaatttatattcacagccgctgaatatacaaatgccgccgctgattgtaaaatcagtggcgataatttaagaatagaataggtaccgatcaggcttacctataggtacgcataagttttattctgggacaatcaacttttatatgtttttgtggaaaagaatctggataatacttgtttaatcgaagaataatatagatattgcatgcatctaataaagactgaaataccctgcaaaccatatgataacaataggtaccttaaaactagatttagttgcggatcgggaacctttcgttcatgatttatatggtcgttgggatacctttaaccgaacctctttagaagggatcgtggatgagattttaagccgttatgatacggaagatgaggatgagcttcttcaaggaaaatttgtggcccaacggcaaacaaagaaccagacagggattccggatcatgtaatccaaggcatggagtcttccttcgggacggatttctcctcggtacgtgtacacccggattcatcgaaagcgccggaggttggggctttggcatatacgcaaggtacggatatccatttcgccccgggacaattcaaaccggatacgtctgccggacagcagctattgggacatgagttgacacacgtcatccagcaagccaagggacgtgtgcagcctactaccgaggtaggtggaatggccgttaacgatgatttatccttggaacacgaggcggatgtgatgggtgctaaagctgcttctgtcttatgaacgagtggatcgattggttccagcgggtattggatgtctccattcgtttgtatttccggcaggagtgcgatttatcttctgtctatgatatcccactcccgaaggcaggaccgctttggaaggcgttgttgccggaacaggtcgatcctactttcgacgagtggatggtgttgatgttggctttaatgcctcatctttctccgcagatgttggatattttttttgtgcataataagaattttgactgtccttatacggaatttggcggttggaaaggactatcgcacggaggattcttgccaacgggtgagacggccgttttcctattggcgggcgatcgtgtggaacgccgtctggaagtggttcgtctatttcgtgaagagcataggttccatatgtatcacgtcgttggcttggaaggagccgggaatggtgaaccgttcttgagcggacaactgcgtatatcggaggatttcttgtaccgtttatcttttgagggagaatataagccggactataatatgggttttctggccaaacggattagtacggctttgaattgggaagatgtcgtattatcttattatgtgcgtgaggagttggaggagataaataattggattacggggcatcgggtcatcctttcggactggggattgagtcgttttttgaaggccggttaccgcactttgttttatggcccgccgggaacgggtaagacgctttgcgcgaccttgatcggcaagaagaacgggatggatgtatatcgtatcgatctttccatgattgtctccaaatatatcggcgagactgaaaagaaccttgcgaatgtattcgaccaagcggaaaaccggaattggattccttttagtgtatttctgtttgtacgaggcatatccggtttgttttatttgttaataataaaattacttccaactcctaaatatccgagttcgagttgttccagtagttcgtctttttggtcaatatatagcaaatgcctatcagaaggaactaatatgcaccaaggttgggaagggctaacgttgaaattttgccttgcctcttccgggtagcggtttagataatagctcttttgttgatcttttgccgtatatacgacatgcgctacgcttaatatatcaatgtccacgatggcttcacactctcgtatggaggtataaagatctgtcgatgagaacgaaagcccaaataccgggatctcttccttatctcgctaaggcgcgatacaattattaatgcgtgcctctgtctggcggagtatatctcctacgggatatccgggctttatccggaggttacagcaaacggttacttcctcgtagaccggagtaatagcgtcaacggtaatgaacggacttgtcttgtcacctatataatcttcgattcgcatgagtagcctatgttcgcataaaggcaagatctttttatctttctccttttgcatcacgaccaatgttacgatcgggctcctgttttgagctttactgtctattccgggcaagcaaagtactttttcgacttcggggaactgagccaatgttatttgctcgtaatccctaggcaatacagcccggttccgatgggacatctcttgggtgatctggagccgcatatcctctggcgtttccggcaaacgtcctcctttagcgggtatgatctggtaaatatccgtaagtcccggcatacttttctcgaaagaaacgagtcccgtgaagctttcgagttcctcactgatcagggcttccatttcttcggggatttctaaccgggctttcactgggtttagatagacatttcgtatggatgaacaattttgcgtgtggcaagatacttttgccgaaagccagaaatctccatttatgtcaagcatttcctcgctaataggtgagggaagcaggatgtctaccaaacctgtattcaacagattcccggttgtatcggaaagcaaattacccggtttgataaactcccattgcttgccgttgaagaaagaccattgtacgcaaggaagatattctttttcgatttcccgtttcaaggcagccatctcgaagaataaacggatctggtcgttaccgatcgagttaccaataccgaatagaataatcccatcttctgtgggtactcccaccattgggaacggatgacgtagatcgatttcatgtaattccttttgcctcaatggatggatatgatagatacggcatctatctcttggggtatcgccattgaaaaagtattcttcctcggcgctataaccgatatctatactttcaatcatagggttgtaaggaggtttgggcaccggggtctgtttacgggtatggctgtttcttatcatgatatccgcaaagagtatccggtactccgtctgcccgaatccgccgttcggatctgtgagtctaatcctgaagaagccttgctgggctttcgtgtattgatattgctcttcttccgtggagaccgtaatgtttttgaacggtttgtcgtaaacgatctcgctgtactccgagagctttcccttaggggaagtatgcttgtttttcgtattgaagagacaagatgtactttccggtaattttacccatttctggtctgttagtttttcccattcaactttgaaggtggtattatcgataggtgtcttatatgcttgatacaaatcatagaaacctccttccgaataaggtagatccgctcattgcaaagtaatacccatggattggataggcttgatcgctatctcataattaccgaatgcgaaccatgagcctttttgagcttctaacccgaataaagggaaatgtacgcttgcgtctacttctcccagaggattatagattttcaaggatgacatgccggatacatgtacctttatctttaagctagtaataaaaatacggtgtacccaagagtaggggaataaccaagcatccgtgttcatcaatatacggagcgctgggttacgtgtttggcaaccatgagcttcagagcaaggtgttgtagggtcgaatttctcattaaggacgaatttcagataaaaggagttttcgttgatgaatgtcaaggtgtaggcgtatatcgggtcccaacctttctctgtgcttaactccaataggaaagcgtcgtttaatacacgcccggtttcgtgggaagattgttccgtagtagcgattaattctttgaaatatgatatagagtcttcttctaatccgaatgtgatatgtatatcccgatgtccttcccgaagtaataacatgggagattcgattatcagtccggcttgtatagaggattggttctcaaagattagctctgagtccagattgggcttcttagaaggaacgtttccgatcctgttattcaactgtttttgccagatggacgtaacgaagcctaatcggctcgctggatattttttcggatctttttccaatagtaacgaatgtatactcgttattttcatgttattgaccgaataatcttcatccgtacgataacaaaattggatatcttgcacaggaaatggtacctgtgttataatacctgtacctttgggtaactgggcttgccgtgtggtattatttttcacggcgataaaccaagcggaaggaataatcgctttttggggagattccttcaatatttggttgacataaaataacggataagcttcccagcgtttattgaactgatctaccagatattgatagtttttcaagaaagcgattaaaacagctaatgagggatcggtctctccgcttttagcgatttcttggatgtaaatctcccgtttgttttgtaaattgcggaggatacgtaataataggtagagacttctacgaaccgttttaggattggatagggttattagctgaagtctctggttatatttctccatatccagaaataaatcggacatggaatctctaaagatccgatgattcaatctttgataccaatcagagaacttatggtatagagcgtttcttagataggtgatttctctgttactttccggtgagttctcattttgccacaaaatgaaactctgttcgatcccgattgtatctgtttgcttgatctcattgagtatggctaaggattggtaatgatataaagaggatgatttcgaaaaggcacgagccaataaattggagagatttttctcgagtacttgaaaaggctcatgtatccggaaatcattctccaatttttttcttgtcaatccatctttattccattgtttattcatcggttagaatcaaaatagataggataggtcaattcttgttggacattattcatacgtatcgtataataaagttcgataatcagaatgccatcttgaatcgaagccttattaatttctatgcgatcaagcgagactctaggctcgtataagagaacagccttctcaatagcgcttttaatcatggtctccatggtaagatctaattgttcaaactgataacgatatagttccgtaccgtaatccggacgatgtattcgctcccctgtgcgagtggagagaaggatgaccaagctttgccggatgtcttcttcataattagacatacgggtgggattatcattatggctgaattctggggggaatgcccatcctttacctaaaaaactatttttgttctgcataattcattcgatttaattaatcattacaacgcctccttttacaacggtttggccggatgcggatatttcggcggtggcagacccttttactttaactcccatttgtgcggaaacctcgatattcaagccatttatcttggtatcttgcttagacttggattcgatacccattccttctgtcttgacattccctcttgccttaaatatgagatctttgccggattctaccataattccgtttttatccatacagaccttgttcttattagcatcggataacagaatttgctttttgtcatcatccaatatgagcgtgttctctccgggagtccctattgtgataatctttttatcatcgtccaaagtaattttcaactggttttttgtaacaattgtctttaaattattttttggatctaaagaaaccggcgtttttcgtttgcgactgtacaaacttccgacaatcacagggtggcagggggcctcattgatgaattgcaggactacctcatcatcgacttccggtagaaataacatgccgaccccattgcttgcgtacggactgaccggccgagcccatatctccgtcttctcacattgtaacaagggtatatcgactaatataaaattctcgaaatctttattatctccgatctttttaacgatccctatttgtaatcctcgtataccgggcaaaaaaccactagctgcgggagcgactacatcgggctcttcggtaatgactaccggattgaaacccatatagacttgtgtcttccattcgcctccttgtagtgtatgttctactgattgaacaaatgcgtttccactataatgtttgcttaatccttctaatttgataatacagcccggaataatagacgcattcccgtaaattgtgatggagccttgaaaacgtgccagaccgctccataaagcttgcgcatcggcccaagcatgtaaagaagcgtcgccgatgggagcgttagtttgataaagcatcacttcatttgccagaccggatagatcctttgcggcgatatcgccttggacattgagaggaggtttgctggcggtggctttgataatttgttgacggctcacgtcccaagcgcaagcttttgtatctgtgtattgctcggaagcggatatagaaccatcgaaagcgattaaattatctccataggtgatggttaagaccggggaggcggatacattcggtttacataccttgacttgtttaccgtcagtgataacgactaatccgttattttgtgctcgtgtgagtacaaaatcccaatctgtacaataatattgtaccagttgtggaatttctataccggtgctatctactttggcggaaagcccgtattgtcccagaatcttcttgataacggtatcatctttactattttcatatacattatttttacgtccaaaggttgcaggatatgcgaaacccctacattctaaaataaatagagtttgttgttcgctattgatttttaactgatgggttgtaacgcatccctcaaataaggtgttgaccttatctgttggacccgcttgaaacttaagctccgtacccggattgaatattttgttgtctggtatttcaaattggctgttgtcgataatatcagcgctgatggagatcgttgctttatcgatcttattacatgctctgtatatttttgcattgattacggagtattgctccgttacatctttaccatttaggaatagtttgattataaatgaattatccatattcattatattttagggaaccataattgagttccgggttttatatctctaaagctgattaggttatttatggaggcaatcattggagcataaccagaatttttatattcttttgcgcataacccgattagactgtctccttgtttaaaagtaacgaatttaccctcagctttttgatttttcttttttgcttgtgtctctctactactaatcgcctctgttagtgacaaggagcctttagctcgtaaaggattgccattgggcgagaataaggtgtaatcccaatttaggctggttaatctccccttgaaaatgagactcccccaaattactttaaggaagcaagggctgggtggatcgatctccgcgctaggaagaaaaatgatattctccaaatccttgatcctttctgtcacggtttttttccccgtcgggataataccggtaccatcgaagtgtatatcaaatgagagagtggaggggttggtgtgtttatactccggtagttgcttatcctcttttatgctttcgtctttcttatatgaggtagatttgcttaacttatagctatccggattgatttggacggtgatactacccaatttctcgccacctttgtattcaattgatttatatgcctcgatgatcaacttttggttcatgttttaccgctcctttctacaagaaaaaaggttagacaaatctttcttggcctcacgaattatctcctctttgatttgttgtatcaaatcacgggagagagggaggtcgggttcctttttctgttgtgtcacttttgtggacacttggatttcttttatagttatagccattgcttaaattgttcttttttcgtatcttctgtatctcttatcgacatacggatcaaattagtataagccatctccaatgtttcaatcaccaactcattcttttgggaattcaatgcgctaatgtcccattttacagggtaagcattgagcacagaccaattatttaggggaaaatgcccggcatccagcaatgatatagttaaattgacgggaacgatctgggcacttccattattttccaatactttaaccacatatgtctctagcacatgaggcaaaggcattaaagaacgtttcaacacaaggttaccgtgctttcgtcgggtaggtacctgatagctgaaactgttttctcccccttctttaatcgtttctgtctccatttcaagttgtagtcccgagacctcttggaaagaggtctcgatcaatccttcgaaagtcacgttgaaataaaacgctaccggaggagggacaatatgatcaaaccttagcattaagcgttttctatggtcaatccttcatgcgctaaatctaaggtttcgatggcagcctcgtttccatcggattttaagctgacgccggtaaccttagtcggccatgcgttcgataatttccaaaccatcgtagggcttcctgcttcatccagtaagctgattgttacatcttctcgctgtattgtgttcatttttatcttgttaaaccaatcgaataatttgttatccgctttgaaaacccctttctttagactgacattgctcgtcttcttcagtcccggcatcttgatatttgagaaaaccgggctattaccatgtcggtactcaattacttgggcttccatatccagaccagatacctctttaaaagcgatttccccgaggctacctaattctaccttaaaataaaaactgggtaacggccatacattatcttgtgcttctcctgccatattcgtatttctttaataggttttaattcttaaattatcagcttttttgcatttgttgttggaatgtgatctcgataaattccgcaggtctggtaatagccacgaatacggatatcctgaggataccttccagaatatcctctggagtcatcgtgtctcccaatccgatatgaatgctatatgcgtcttcgggggaagttcctgctaatccacctcgtttccatacgccccgtaagaatccatctatcatactacgcatatttacccatgtatttgctacattcggttcgaatacataggcacgggcggcgttcttgatcgattcctctaggaagatcatcgtacgccttacgttaatataacgccagtctaacgagttaccatccatcgtgcgggcaccccagaccttgattccttcaccggggaagctacggattgcgtttacggcttttccgttcatcggtacgttcagatcttcttgctcggcatttgtgatcgagagtgcgggcgtgactacgttattgatggaaatattcgcgggggctttccatactccccgggtgttatctaccatagtataaagaccggccagcgaagctgaaggcggaagtaaattgatcctcaagcgaatctctctcaaaatggagcggtatacggaactgacttggtataataaggtatggaaacgttccgcttcgtcctctttcatggtaagcaaaagcttgaacttgtccataagttcattgacagcctcattcgttacaccggacttctttgagaattcgttcaagatcagttcctctaatttctctaaactatccttttctatattataaaaagtgatatctttctcggtgacgatagatgtatttatccatggataataggaggcacagtacgcaaggaaattgctacctatattttcccggaaacttttgataaccgcaccgttttcatctttgtatccgttgaaaacatctaatatggcaaagcgatttttcatgtcgttaccacagtgcatcaaagcggcagtttgaactttgtaacaatcgccttcctccatatatacggcttccggaacgacgaccaacgtgggctcctgttctttttttaaggctaagagcgcatttgtaaagtctatgcttttaaagtcatgctcataatctcctatggagacgatatagcacggtcctccaccgttagcgtagaacaacaacatattataatataaagcatagaacgtttttggcaaagtaagctggcaacttccatcggggaataatacgtttatgtcattggtggtgtcctcactctcggaatcttccggacgaattccgaatcgcaaggtgggagcgaaaccgaagaacgaatggaactcagccatagaagatatacggaaagggataccggtcaagtccttgttaccgtcccgtgcgaattgggtatgcccgataaaggcagggatggcggtagcgacttctacgactgaattaggaaaagcgtttttctctatgatataaacgccaggggttttcatttgtgccatacgttattttttaaaggatttagatataaagaatttgtataatagaattctcggtagattgtaattcctttataaggaaacgtcccaaagagggaacaggaacatgccttaatagcattcttttagcatattctcttttctcgtaaatcgtgatattagatcttctttggtaataagactcttccttaatctttatcggatattctgtgctgatacgaaaaacgtccttatccatgaaacggatttgctcgggattcttgaagctaatattttccggtccattatcctccataaaaatatccattgacgcattttctggattacgaggtatcaagataaaatcccaataggcttcttttgtgtgataatggatttctttctgtattgggcatttcgtttctaataattctttggtaacatgaatgatcacattgagccgattcagtcggttatcgataacacttaattgtatatctgaatcatttagctcttccggtagcagggattgtgtatacagtaaaaaattcggatcttttgaatgtgcttgaaactcaaggttgagaccatccggggagattgaaaggtgatcaagaagctcttctcgatctccaattagtgcatattgatttcgccccgtttgcctaaaaggatatttaggtcctcctaatacgactctattcgttctcctgggttctatctcgaagatttcagaaggaatacattcattataatattcatggctaaatataatgttaattaaaaagtcaaatttcatcattggtttgttttatcgttataatattccaaaagtagataaaaagaatatggcatgatattaaatgctatatgtttgataacattatttctaatttattttttgacttgatattcgttgttttatatccttgatttctgttccgtcaaaagatatgattcgtgctttacataggattgatggataataatgccctcctaatatactccatatattgctgagttcttgcatactaattgttatgggctcgagcgttatggtaccttggtctggtaatttaagaatggaattttgttgtaagaaggagattgaatccgataatatttgtatagattctaagtatcttttagatgaaaaaacagcggcaaccataatatatatattcaagtaccatggtggagatgtttgttggaatgtgttattttttgtgttcctatagggggcagagattcccattgctgtctctcgctctatattcacgatagaaagtatgattttatccgattgatcctcatttggagtcgcatcaatacttccggcttccactataatttctgcccgttcataatagctggaaagaaattcgttcattttctctgcgagtgtgtttattaatacgtgtatcatggtcttttgctttatttgtgctaaaggtaaggaataaatttgtttttctgctttataatttcattgtctgaattctttctagcaaattaccttcgtttcgattcgtgataagaattaaaatcgttttttgattgtcatagataattacgtcttggcggtttcctgaaaaagattgaaagaaaagttgatcctgagattgggctatgcttattgtgtattttttatctactcttattttctattatgtgacttcggaaaaacacgtacgacttttttcgaaaacacgtacgacttttctcatgaacatgtacgactttccggtaaaacataatcgtgtttttaagctgttaatgttcagtgatttatatttttgtatcattcacgcacttattgtatggaaaattatcacatcgccactcaataaatcatatatacctccatgtagaagtgcggcacgctatgtctctataacaggatgtctccaatagggtgagaatcgagtagtatggctttatcacacgtacattatataacttgttaagtcttgaaaaaaaacttgaaaaataatgctgaaaatgtttggaggttatgttttatagcactacttttgcacccgcattcgagagagaacgccggtataaaatgatgaaacaaacttttagaaaaaaaagttccggaataatttggaagtttaaaataaaagtctttatctttgcagccacgttcgcaaaacgaaagcgacaaaagagttctttgagagatttacataattcaacaagtagtacaagtataggagaagaaattttccggatcgataccgtcaatagaagtatgactttggactacaataacggattccggagcgaggatatgataaaacaatttaaacaacgaagagtttgatcctggctcaggatgaacgctagcgacaggcttaacacatgcaagtcgaggggcagcgggggtagcgatacccgccggcgaccggcgcacgggtgagtaacgcgtatgcaacttgcctatcagagggggataacccggcgaaagtcggactaataccgcatgaagcaggggccccgcatgggggtatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgagggatgaaggttctatggatcgtaaacctcttttataagggaataaagtgcgggacgtgtcccgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacattgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtagccgtaccggaaggtgcggctggaacacctcctttctggagctttaggattccgtaccgaggtcatacgaggtatcgatcgccttgtgctgctgttgagattatgtttattatatagatcaatgaccggaaggccggtcggagagaaaaagatgacgctgggacgtaagtcttggcaaagttgacagtcctatagctcagttggttagagcgctacactgataatgtagaggtcggcagttcaactctgcctgggactactccgaatgaggggggattagctcagctggctagagcatctgctttgcacgcagagggtcaacggttcgaatccgttattctccacacatcccgcgagggaaagaggatctttgacatgttggacatcaaaaagaagaaacaagtagagcgagcttaagatatatcaacccgtacgtcaagtacgaggtgagagaaagtaagcaagggcagacggtggatgccttggctctcggaggcgacgaaggacgtgataagctgcgaaaagcccgggggaggcgcaaatagcccttgatcccgggatatccgaatggggcaacccggcaggctgaaggcctgccatcccgaaagggaggcgaacgtggggaactgaaacatctaagtacccataggaggagaaaataaacaatgattccgtaagtagtggcgagcgaacacggaagagcccaaacccatgtcgtctaggcgacacgggggttgtaggaccacgacgtggcaagatagagtcaagtggaacgccttggaaaaggcggtcatagagggtgaaaaccccgtacacgactgacgattgaagcctagtggcatcctgagtagcgcggggcacgagaaatcttgcgtgaattagcggggcccatcccgtaaggctaaatactcccgagagaccgatagcgaaccagtaccgtgagggaaaggtgaaaagaaccccgagcaggggagtgaaatagaccctgaacccgtctgcctacaagcggtcggagcgtcgtaatgacgtgacggcgtgccttttgcataatgaacctacgagttaccttccccggcaaggttaagttcttgaggaacggagccgaagcgaaagcgagtctgaacagggcgccaagtcggggggggtagacgcgaaaccgagtgatctacccttggccaggttgaaggttgggtaacaccaactggaggaccggatgggtaagcgttgaaaagctttccaatgagctgagggtaggggtgaaaggctaatcaaactcggagatagctcgtactccccgaaatgcatttaggtgcagcctctttatagtatatcgtgaggtagagcgactgattggatgcgagggcttcaccgcctatcaagtccagataaactccgaatgcgcgatatatatttacagggagtgagggcgcgggtgctaaggtccgtgtccgagaggagaagaatccagaccaccggctaaggcccccaaatgatcgttaagttgaactaacgaggtcggatcgcagagacagctaggatgttggcttggaagcagccattcatttaaagagtgcgtaacagctcactagtcgagcgatctggcgtggataataatcgggcataaacgatctgccgaagccgtggatgtcgcaagacatggtaggggagcattccatgccgcgtcgaagatgagggatgacccttgttggagcgcatggaaaagcaaatgtaggtatgagtaacgataaggggggcgagaaacccccccgccgaaagaccaaggtttcctgatcaacgctaatcggatcagggtgagtcgggacctaaggcaaagccgaacggcgccgccgatggaagaatgggttaatattcccatactgcctcatggagtgacgtggagacggagaagtgacagtcctgccggctgacggaatagccggttgaagggtgtaggtgtcgatcgcggtaggcaaatccgccgcgagagccgaacctgacagtatacggagcgcttgcgcgacgtaatatggacgtaaccatgctcccaagaaaatccgctaaacttatccatgcggcacccgtaccgtaaacggacacacgtggtcgggttgagaatactgaggcgctcgagtgattcacggttaaggaactaggcaaattgaccctgtaacttcgggataaagggtcctcgtcgtaaggcgaggcgcagagaataggtccaggcaactgtttaacaaaaacacatggctgtgctaaatggaaacatgatgtatacagcctgacacctgcccggtgccggaaggttaagaggagatgtcatccgcgaggagaagcgttgaattgaagccccggtaaacggcggccgtaactataacggtcctaaggtagcgaaattccttgtcgggtaagttccgacctgcacgaatggtgtaatgatctggacactgtctcaaccgtgagctcggtgaaattgtagtatcggtgaagatgccgattacccgcgatgggacgaaaagaccccgtgaacctttactatagctttacattgagtttgggcagacgatgtgtaggataggccggaggctttgaagggggtacgccagtatccttggagccgccgttgaaatacggcccttcggttgtttgagttctaactcccggacgggaggacactgtatggtgggtagtttgactggggtggtcgcctccaaaagcgtaacggaggcttctaaaggtgccctcagaccgattggtaaccggtcgcagagtgtaatggcataagggcgcttgactgggagagatacaactcgatcaggtaggaaactagagcatagtgatccggtggttccgcatggaagggccatcgctcaaaggataaaaggtactccggggataacaggctgatcattcccaagagctcatatcgacggaatggtttggcacctcgatgtcggctcgtcacatcctggggctggagaaggtcccaagggttgggctgttcgcccattaaagtggcacgcgagctgggttcagaacgtcgtgagacagttcggtctctatctatcgtgggcgcaggagatttgaggggctctgacactagtacgagaggaccgtgttggacgtaccactggtttaccggttgtcccgccaggggcaccgccgggtatctaagtacggatcggataagtgctgaaagcatctaagtacgaagccggcctcaagattagatctcccttaagggtggttatagacgatgaccttgataggccacaggtgtaagggcggcgacgtccgagccgagtggtactaatagcccgggactttcctcacgtgagggttgatatattttaagacgataaggcgaagctggtctcttcggattgatgtccggtcaaaatcttgataatgaaattaaggtggctatagcacgagggatccacctcttcccattccgaacagagaagttaagcctcgtcacgccgatggtactgcgtaacagtggaagagtaggtagccgccgtcttgaagaaggcgatagccgatggagaggagtcagtccgtaaggggtgactcctttttctgttatatacaccagccgtcgtagagacctagcgtgccgcatctcgtatcgtctgacgatattctaagttaccatttgaagggatgagacgctgcacgctacgtctctacaattgggtgagatttcattgtttgctgaatcgggaacaataaagttcgtatcttgccgttatattaagaattcaccgaatgattctgatttatgagcagcatatatgattctcgtcaaagatggaaattaggctttatttttgccgctgtattgatcgctatggcttctgtggtagtctcggatctcttgattaaagatctggcccgagaagagcgtcagaagatcgaggtttggagtgaggcaacccgggtcatgaccagtgagaatccaagccttaatatgaatcttatcctaaaaatcatccaagggaatacttctattcctgttatattatgcagcgagacggatagcgtggtttcttacaataatatagagattccggaaaagaatgtagcgcagttcatgacgaataaggttaaggaactgagaaccaaaaatcctccgatcgtaattgacatggaggatggtacttaccaatatttatattacgatgattcgattatcttaaagcgactgcttgtttatccctatgcgcaattatcagttgtatttgtttttatattaatcgcttttttagccttggctagtacaaagaaggcagaacagaataaagtgtgggtggggttatcgaaagagacggctcaccaattaggaacgcctatatcctcgctaatcgcttgggttgaatatttgcgaacgaaagatatagatccttctctattgacagagatggataaggatgtgaaacgcttacaaacgatagcggagcgtttctctaaaatcggttcagatccggatccggttccgacaaatatcgtggaatccatccgtgcggctttgggatatatggagacccgtatttcctcgaaggtgaaaattaatacgtatttgccggagcggccgatattggtcttaatgaatgattccctgttcgcttgggtaatcgagaacctgacgaaaaatgcggtggacgctatggaggggcagggtgagatttcgctaaaagtagaggaaagagagaaggtcgtgctgatcgatttggctgataccggaaaaggtatcccgaaatcaaaattcaagacggttttcaatccggggtatacgaccaagaaacgtggctggggactaggcttgtccttggtaaagcgtattatcgagtccttccaaggaggaaagattttcgtgaagagttcggagctggggaaagggacgacttttcgtataaaattgaagaaatataagggttaaatcgtattataggaaaaaataagcataaaggtattgtttttgtatttagttttttcgtacctttgcaaggtttttacactaaaaggctttggggaaatttaaattatataatgtagatttgaaaaatctctctccgggagtacacgaattcgagtatcttttggagaacaagttttttgtggacattgacggaaccgaggtccagaagggcaaagtgaaggttcatcttaccgtaaaacggtcgtcaatgatgtttgagatgaactttcagatagaaggggttgttgttgttccatgcgatagatgcttggacgatatggaaattcctattgatacccacaatcgtctggtggtaaaattcggcaaggaatatgccgaggaaagtgatgaggttgtcgtgataccggaagaggagggcgctattaatttggcgtggttcctgtatgagtttatcgctttggcggttcccatgaagcatgtacatgcgccgggtaaatgtaataaggcaatgtcgtctaaattgaagaaacataccgccagaagttcggatgagaccgaagacgattttgaggatgacatgggaggtgatgatttggcgttggaagatgacggaaacgctagtcctgccgatcctcgttgggatgctctgaaaggtttgctagagaatgataacaattaaataaataaaacaatggcacatcctaaaagaagacaaggtaagacaagaacagccaagagaagaactcatgacaaggctgtagctccaacaatggcaatttgcccgaactgtggcgcatggcacatctatcacacagtatgtggtgagtgcggttattacagaggtaaattagcgattgaaaaagaagctgctgtgtaagtttgtcaacttatatggtttgatgaacaaaagaaatagccctaaaagtttttttagggcttttttttaattgggataagtagtccttttatttttaaagttatggataagataaatgcggttatcacaggagtgggtggatacgttcctgaagatgtattgacgaatgaggatatttccaagatggtcgatacgacggatgagtggatcatgactcgtgtgggtattaaggagcgcaggatattgaaaggggagggcgtaggactctcttacatgggtatacgggccgtgaagcaattgctcgagaaaacgaacctgaatccggaagaagtagaggttgtcttgaccgctacgactaccccggatcatcatttcccgacaacttcttctatcatcgcttatcatacaggttgtaagaatgcgatgacttttgatatgcaaggtgcgtgcgcaggcttcttgtatgctttggagacgggcgctaattatattcgctcggggcgttataagaaggtggttgtcgtatcgggtgataagatgacatctattacagattatcaagatcgttctacttgtcctttgttcggggatgcttgcggagcggtcttgctggagccaactaccgaggagttcggtgtcttggatactattttacggacagacggcgtaggctatccgcatctgatcatgaaatcgggcggctcggcttatcctccttctcacgagacggtggacaaccgtgagcatttcgtttatcaagatggacgtgtggtgttcaagtacgcggtttcttatatggcggacgtggccgctgagatcgcggagaagaatggcttgacgcatgatgatatcgcgtggatcgttcctcaccaagcgaacctgcggattatcgacgctacggcgaaacgcttgggcgtagatatggataaggtgatgatcaatatccagaaatatggcaacacaagcgccggtacgattcctatttgtctatgggaatgggagaatcaattgaaaaaaggagataacctgatccttgccgcttttggagcgggctttacgtggggagcggtttatctgaaatgggggtatgatggaaaaaaagcataaatcgggttttgtcaatatcgttggaaacccaaacgtaggtaagtctacgttgatgaatcgtttggtcggggagcggatctctattatcacctcgaaggcgcaaacgacaaggcatcgtattatgggtatcgtgaataccgacgatatgcaaatcgtgtattctgacacgccgggagtcttgcggccgaattataagttgcaggaatccatgcttaatttctctcaatccgccttaggcgacgccgacgtgctgttgtacgtgacggatgtcgtcgagacgattgataaaaataacgagttcctagcacgggtacagagcatagagtgtccggttctcttgttgatcaataagatcgaccagaccaatcagccggagctggagaagctcgtggcccagtggaaggaattgcttccgaaggccgagatcatcccgatctccgcgctttcgaatttcaatatagattacgtgaagcgtcgggtggaggagttgatgcctgattccccgccttatttcgagaaagacgccttgaccgataaaccggcccgtttcttcgtgacagagatcattcgtgagaaaatcttgttatattatcagaaggaaataccttacgcagtagaagtggtcgtcgagttgttcaaggaagatgatgagctgatccatatcaaggcgctgatcatcgtggagcgtgatacccagaaggggattatcatcgggcatcaagggcaagcattgaagaaagtaggtgctatggcccggaaggatatcgaacgtttcttcggaaagaaggtgtttttggaaatgtttgtcaaagtggaaaaagactggcgtaaccgtgacaacatattgaagaacttcggttatcagctggactaataatagcatacgaaaggagaatttatgggaaatatagtagcgatagtggggagacccaatgtaggtaagtcaacccttttcaaccggttgacgggtacccgtcaggcgatcgtgaacgaggaggctggtactacccgcgaccgtcagtacggcaaggtggagtggaccggcaaggagttttcgctgattgacacaggcggatgggtggttaactcggaggatgttttcgaggaggagatcaacaagcaggtaaaagtggccatcgaggaggcggacgtgatcttgttcgtcgtcgatgtattgaacggcatcacggatctggacatggaggtggcgcagatcttgcgccgttgcaagcggccggtgatcgtggtggcgaacaaggcggataattatgatctgcatccggcctcggcggagttttactcgtttggcttgggagatcctttctgcatctcggccatcaatggttcttataccggggatttgctggataagatcgtggcgacgttgcccgaggagaaggtggagatactggaggaggagttgccccgtatcgcgattataggacgcccgaacgcgggaaaatcttctcttatcaatgcttttattggcgaggatcggcatatcgttaccgatatcgcgggcacgacccgtgattccatctacacgaaatataataaattcggcttgaacttctatttggtggatacggcgggtatccgtaagaaggggaaggtgaatgaggacttggagtattactcggtgatccgttcgatccgcgcgatcgagaactcggatgtttgcgtgctgatgttggacgctacgaggggcattgagagccaggatatgaatatcttctcgctggtgcagaagaataagaagggattggtggtttgtgtgaataagtgggacttgatcgaagataagagccagaaggtgatcgactcgtatacgaccgctatccgcgagcgtctggctccgtttaccgacttcccgatcttgtttatctccgctctgacgaaacaacgtatcctgaaggtgctggagaccgccaaggaggtttacgagaatcgctccaagcgtgtccctacggccaagctgaacgaggtgatgcttccgatcatcgagaattatcctcccccagcatggaagggtaagtatatcaagatcaaatatatcacccagctcccggcgggcagcgtgccttctttcgtgttcttctgtaacttgccgcaatggatcaaggacccgtacaaacgtttccttgagaacaagatccgcgagaactgggattttaccggtacgccgattaatatatttatccgggaaaagtaaatactagatacaaaaaagccgcttcctgtaacggggaggcggctttttctatttagaataggtcggaatgcgttccgatatcggtgaaaagcaagattagctccgtgtcatcttggctccatatcagcagccagtctccttggatatggcattcccacaatcctgcgtatttcccggatagcttatgcgggtggtattgggagggaagggaaccggtatttttgaggatttctacagtctctaataagaggtttatatccaagtgccgcttcttgcaccgcttgatgtcacgttcgaatttggaagtggtatgtacggtataagtcatagctctagcattttttgcttgaatgcctcaaagttctcgtatttgtgtatccttcctgccttcacgtcctccaaggcctcgtccaatccggatttcttctgtgccttcaccttgccttccagcgaagtgatgaatttcttcaagatgtcggcgtatttctcggggatggttacctcgaatgtctttaatgatgtcgttgtctccatatcgctctgttttaggaatttccttcgcgaatatacggaataaaaagagaaggggaattgttttccttctctttttatttcccgcttccgcgtcgggagggagggacgtgacggttagatctcgtccgggctctcggagtctccgccgggcgtaggctcgggtgtaggctcgggagcgggcgccggtttcttggaggcggccatgcgctggttgtaggcggcggtggtctcggcgatcagctggttgagggcggcgatgaaggcggtcgctttctcggacggcttcgctatgctatgggactgggccagcagggtgagatcgtcataatacatgtcgatccgcttgcgcaggttggcgccgctttcctttttggaggtggtccggttttggacgcgttgctgcgacaggcggtcgtaggcgttattctctttctccagttcggcgaggtaagcgtcgaggccgagcgtggtgacgtacggcttgttctcgtccttgcgcaaatccagcaagaggccctttatcttggcggtctcctgcgccatggggaggcgggcgaccccgttatagggcttgatgaccttgtatagatacttgcccgcgtcacgctcggcctccaacgggagggtaccggcccgtgagatgcgggtgatgatatagatagcgaggttgtcgcggttggtatcgtgcaaggtcatttgctcggtctcctgcgaggtgcggctctcgtccaccacgtcggccatggcgaggaggtctgcctcgtaggtctcgaggaattctttggtgaggcccagctcggggatgccgtcgttgccggtcagcagggagatctcgtcgggggactcggaatcgccgtcaccgctatttccgttggctaggtcgaggacgtggttcatgaaggagaggtactcggcgttgttgaaaagagagagcggaagtgtcttgatttttgtgtaagtactcatggtaaatttgatttagagtttaaaaacttctctaagttagggatatttgctgaataagggcttcttaggtctaaaaaatggggattgaatggcgcgaataatcatcttagccctaagaagtcatttttcacccttcgagggcatttcttagggctaagagacattaagaatctgattgttttgcgaatgttttaaaaaaacacgatcttcgcgacgtattggaaaaataacgtagaagcgtttcgatattatcttgtactggaatctggacaatttcattacccaagataataggaaaatggctcctgcgctttatctgttatatacctacccattcatggatagattatatacctgcataaggcgtgggatcattgtcttattattgggtaagggcagtccagagcctcagtacagtgatagacaatggtctccacgcttcttttatttgttaaccgcctaccggaggaggcacgggaggaagaatgtgataaagatatgagaaaattggtttatttgttaggtttattattttttatggcctgtggagaagatgctaaagagggaattattcctgaacctgatgttccttatgattatagtgagttcggcggctatcatgtgaaggatactgtcggttacgatatggcgacgcttgagttttactcatctaatgatacggcttggatttatgcgattaaaggtcaaaaggtgtggtttggtatgttcaatgacaatacgaaagaacaaattacggaatggaaggcctcctcaagtgaggaatcagactacaccagttcatttcttggtaatccatttaaggtaggagataaatatgtatgtttcatgaagattgctcctgagttatataaaccttttttgttgaaagaggaaagcgctatctctcttaaagaacgagaagccagttggggaagtgagaactttttttcagttagagagtttggagagaatatattggtttatcatcctcatttttatggtaacctattatattcatcagaaggagttgaggtcataaattctgtggcttttcaggatgatcctgaatctgataatgagtatttatcaggttttaagaatgataaagtgtggtttggtatatacgaaaatggtgaattgcgagaagaatatacgggcgagaatgtttatgatagaaatataaagatcaataaaggatatggcgaatacgaggaatattttgtgaaggccttgtctttcggttattcgagcggtttgttgaaaacagaatgggggtatgtattttatcctacgatcaaagattctgaaagtggtggttatattcatgatatgtttttttgtaatggagggaaaatgtttccggtctttgttggaacatattatttagatataaggaattggtatgatggaagtgttctaatgggtaacaaagtagtcttctctccggaaggtaagaggctgatagaatttgaagataatgatctaggagatgataggatgttgagtgtattttgtaaagaacctagttcttatactcatataataaggttgatgcatgcaaggatgtgggctgattatacggtggttactatcgacaaatatgatttggaatcaaagaattctctttggagcgtgaatgtggatgcgctgggagaatgtgctgtgaatagtaaatttgttgctaaggtattgggaaaagataaaaatatttggacgatggaagtgtctgtgatatcatttgaaggacaagaaaagatctcgaattttaagttgaatacggatacgggtgagattatctatttataatcattatctgtgataagatccttttaacggattagtgaaaatatctatatgaccataaaaccttctccgtcaaatcttattgtatgaaatggagaaggttttatagttccatatattttatttttccaatatccctatcatgccccccttcagcaccgggatatggtttatgataagcgtccaaagaaaatcgggatcgatctttagtatcctattttggcctaccctcaaagtaactctcagtctcttcgatagaaagtagcacatcataaagatgtttctcgatatattcatccatagatcagcaattttgtattatcaatattctttcttaggatcgggttccggatcgacttgtcctctagcaagtcgatctcccggtggaagatggcagataaggcgttgcgcagatcgaagaaattattcacgtaattcacctgttccacctctttgtcgaaatccaccacaagatcaatatcgctcttctccgtgaagcggttcgtgaggacgaaacctgaagcgaaccgccggccttgtcttaagcctccaccccattcctgtacaagtaatccggagcgaaatctgccccattgtaccattcgagcgcccagtgtgtgagcccgaactggacgaaattccggaggtctttcaatggctcgaaaagtttccctttcagtaaagggaggaagttcactaatttcaccttaccgttgctaaattccaatcgcatggtatagccctttacatattccacgccagtgacgcgtattaaatctatatcttcagtcataactttttctcttttaaatgggtcttaggggattttcatcacgaatatatggaataaaaaagataagggtacgagttcgcctctcttttttgtctttctttcatccacatttccttgaaacccttggaatccccatttataatcgtacctttatgtctctttaccttaaaaattaaaaataatcatgtttacgccatcaatgacaaacgaggaaatagaggcagtggcctataaggactttctggagatccggggaagagtggaaatcgcgaaggataaattcgtacaaagggtgagatgcacgcccccgggattttgggccttgcattccttgcaggagacacatacccttcaaacccgctccaagaatacatggactgtatatttctattatttgtacacgacaccggccggtgccgtgaaagtctcatctatgatctacacctccctgccgggagatgaaggcacggattacctgtttatgaataatctcgaccgctttcggctggagagggtgagctcgcgtttctcgcgacaatacgaggaacgctatatcgacccgaaccagatccaactgaacggccttctgcccgctatctatttcatgaggactgccggcgaccggaagatcgctccctacactcccgatacatggaccgaggaagagaaaaaggacaaatatctcttcgtgtcggagcaagggaccatggaggcgaagctggaggggcgtgtggagacctaccttactttcttagagccggaacagccgggtgattaataagtagagggcgaggttgataccccgccctcccgataactaggtagatacctccgggcttatcttttcagaagatcgatcctctcgccgggcaacagtaccgcatgaaccttctccgttacccgccccttcacgttgaaggaatcccttaggcggatgtcgtcggcggaggagccaatctgcgcctcatatttaccggactctacgacccaatgactggcgctctcgtcgaaggaggccagatccgtatctttcaccttgaagatgatctcacggctctcccccggctggaggagttgggtcttgacgaaacctctcaactctttcgccggcttatccatgctcttgccgggggcggagatatatagctggaccacttccttcccggctaccgggccattgttcgtgatcgtgcaactgatgctgtagtccgtatcgcccatgaacactttcaagctcgaataattgaaagttgtatacgactgtccgtagccaaacggataggagacgggcacgccgaacgtatcgaagtaacggtagcccacgtagataccctcctcgtagttggtatagtcaatattcttacgatccgtatgctccgggcctcctcccatgaaaccggctaacatttctttcaggtcgatatccgaagcgtccgggaaattcttcgtggaggctacgtcggcgatgctcacggggaaagtcatcgggagcttaccggaaggattcacctttccggacaggatatcggctaccgtgttacccccttcctgcccggcttgccaagccaataggatggcgtccggttccgatttccagctggcggtctcgatcacgcctccgatattcaagattacgaccaccttcttcccttccttatggaaagcgtcggaaaccgattggatcaacgctcgctcattctccgtcaggttgaaatctccctcgatcttccggtcttggaactctcccgagctacggcctatcgtaacgaaggcgatatccgcctctttcgccttagcggccagccctgcggcatccggtacgaactccgggatacgagggtggttgaagaaagcggcggcgggactcgtgtctttcggctgtttcgccttttcctcggtactgtatttctcgtataaggctttcacttcggcgtccatggtataaccggcgttctccagaccttccacgagggatacggtataagccttgttcacgtcgccgctgccggtgcctccggcgataaaatcgtacgaggtggtaccgtaagccgctatcttcttgatacccggggccagcggcaaggcattattcgtattctttaataaaaccataccttcggaagcggacgcacgggttacctcggcgtgagctttcaggtccggtttgtcggaatgggcgtattgggcaaagcggggggcttgaagaatcagtcgtaatacacgggttacgtccgtatccacgtcgtcgatagagagagaaccgtcctcaagcgcttttaggagggcctctttctggtctggccggccgggcatcagcagatcgtttccggcgtggatctgggcgggggcgttcttgccgccaaaccagtcggtcatgacaaggccgctaaaaccccattcgtcacggaggatggtcgttagcaaatcacggctttcggaggcatactcaccatttatcttattgtaggaagacatgaccgtccacgggcttgcctcttttacgaccatctcgaaacctcttaggtaaatctcccgcaaggcacgaggggtgaggcgggcatccgttcccgtccggttggtctcttgattattgacggcaaaatgcttgatggaggttcccacgccattgctttggataccgtttaccatcgctgtcgctatccggcccgtcaagtagggatcttcggaataatactcgaagttacgtccgcagagagggcttcggtggatattcagcgcaggggccaagagtacgtcgcaaccgtattctttcacctcgtcgcccatggcgttgcctacgtttttgaccaatgcggtgttccatgtggaggctagcaaggtagcgaccgggaatgccgtgcaataataggtcgcctcgttcccctcgcgagtcggggagatacgtaatccggcgggaccgtcggccactacgatagcggggattcccagacgttcgatcgggaaggtcgttccggcggctcccggcactatattttgcgtgctgccgactacggctgattggccgccgaacccgggcattccggttccgactaacagggatactttctcttcggcagtcatggcggctacgattttctcgataggatctttacccaattgcggcaaggtttgggagtgccctacttgcatggccatcgtaaggcatgtgcccattaatagtttgttcatatagaatggtttttgtgtttttcagtgccccaaaaataggcgaaggaatcgaggcggacaaagaaaaagaaaggtatcggaggtaaggatttcgttttttgatgaatatcaaacattgtaggggcttgatgatatatttaggggacgcagactgcgtgctctgcgtagtctgcgtcctgtactatttataatgtattcagaagtttatgaatctcattaaccatctgcgtagcggattcttgtgtctcggataaaccttccggagtgatcttggcaaccgtcttgttcaacttctcgagtttgcctttagctcctttcgttgtcagctcttcccggaggatgcggatcttctcgcaatcttgtataccctcgaccaaacgttcgaagcgaatgctactgcgtggaccgggataaatactgtatgtatcgcctgccgcccaagtgcggaaacgcgagtcacgcagaggatcggcggtccagctattaactgcccaacgtagataaccgtcgtaaccaccggctacggcgtgcaagaccgtccacgccgcttccgccggatcggagaaggtaaaggtattcgggaacgcttctgcgcaacaggtataaacggtactgatctgtcccgctttatcacgggcagcctttacgtcttctgggaatttatgtccatagggaatacttaaatagtataagtccgattgaatttccggatgataatttccggccagcgtgatcttgaactccggatcggcttgcttgataaccttgatcgcctcacgcatcgcttccatcggacgctcgtccatagagatagcggttttctcgaaccagcctttctcgcgaaggtggcgggagaaatcttttaggaaagtaccccaatagtctgcgtaagcggcgtcacccggtttagtgttgaggaattgtacacgatttgtcgcctcgtcgtaataatcgaaagataaagcccaagggatcatggtgtagcaactgatcatatcattgataccgatctcgttcatcatgaattccacccatttgtcgaagacggcgtaatcatatgcccaagtgccgtctatcttcttgatccgggtgatcatgctgtcgaaatgatcctcggtttgtccggcccaaggtttatgcatgatactggtggtgatagcgcgctgtccggcgttcgccagcattttcatgatcgggcgcatagcgtcgaaatgttctttgctccaaagaggaacttggtagtaacgggccacggaatacgggttctgccataagtccagatggaaagcccagtccttcggggcgggaagtgtgcggttcaatacgtccacttctatttgtaattccatgggggaggtattttttcccgtgacggtcaatgtccctttatatttaccggctttcgcggattgaggtacccagatattcatccagatcggctgggtggtgcgtgccttgatatcacggatctttacgatatccaatacatcggctacgacggaggaatcccattccgccttattctctcggtggccgcaaccgcctttacggtctttattcaactcatcggtcatgacgtaacggacaaagttcgtcgtgatcgcggaggatgggatgatggaagaaccgctcttcaagtcgctcacggtgatagaggcatcctcgagtcccaccttggtccataacacggcttgcgcgtttacccgttcccctttccatgctttcgtctgccagcgattgcttttcttgacatcgggaatactgagtttcggatatcgtatatcggtcgtaccccagcttaattgggttggggccgataacttgtcccagatctcgtcgctgtcatgcggtttcgtgtcggtcaattccgtatagtcgcctagcgggtatttctcggattgctgggctacggtaaaagaacttagtgccagaaaggcacaaaggatgaaagtgtttttcatacgattgcttattttagaatattaactagggcaaagataggaattaattgtcacttgtcaactaacctcttgtagtggcatacgagcagattcccctcatcatcgtataagtgcatgccgttgccctcgcaataacggaacatcttacaatccgcgcattccccttttttagcccactggcggttacgatacggtttaaactcattattccagatatcaatgaaatcgtctttatagatgttcccttggtggaagttcgcccgtatactgggacaaccggagatagcgccatcagcgaggacagaggccgtattgataccggcgttgcattggaaaatcgagtctctcacctctgcctcataattcccgaggaagccctcacagccgtagctaacgtgtatcttaccctctttccggcagaagcggatgaagttcatgacccatgtgaactgttcgttcgtcagttgcaaatcggtctcagtcgcggcacgtccaactgggaagatcgtaaagatacgccaccgttttacgcccatctcgatcaaaaaatccttgaagagcatcaaatccttgaagttgtgttggtttacgcaagtcaccacatcccagatgatctccttttcctcggccaacatacagatggcattcagtgccttctcgaaacttttaagattacggcgaagccagttatgcgcttcctcgaaaccatccaagctgatagttgccgagtgcaatccggaagccaagagcgagtcgagccgttcccgggtcatcagataaccattggagacgatcccccaaggatatcccctgcgatacagttccagcccgcatttctcgatatccttacgaatcaacgcctcgcctccggtaaagatgacgagtactttgttcggctcgacataaggcgtgatatcgtctatgactttcaggaagtcctcgacaggcatatccgggacagaggccgagacatggcaatcgctcccgcaatgacggcaggatacattacaacgaagcgtacactcccaaaagagtgtacgcaattcatgtaatttagccctgttcttcttgatacttcgaaaaagctctagggcgatacgttttttgatgtttgggcgtttgtccatattttattcttttttctctttaagtttgatgtcggggatgttaacctccgctttcccatggaaccaagatttacctccctcaaatccttcgatcttgacatctatcgaatccgtctcgaatgatccgttttcaggcccgtcaatatctttagcgataatgcgtacgatgcccattggggaatcctcgaattttatatcgtaacttccgtctttttgggtttggggcgatttatacatctcgcttatatatgaggaaaataatacgttattatatatgcctccatagttgagctctattccttggatgggatctccgttcatatttgtaacttttcctttcaactcgtattctgcgtaagggctaccatactcatctgtagcgccacaggaagtaacgctgaagcctagtagagaaagaagccccgctaaaatccagttaaaaccttttaatatggaatgatacactgttcccattttctagtttttgcgtgttagttggaagttaatttcttttgatcctttacccattaacatccctttcccttgtgataattcaatttcggcgaaatttacgatatagaatcagttttgcaagcgtttgggtcattccaatacgaagataattttgtgtagatggtatgttcgattgtcgtagccttatcgtaggtgaattgatatcgtccggtctcatccgtgatagccggaaagctggaaaggtcgtcctcttgagtaggggtatatgccggtgaggttaagattgcgactccggccagcggataaccttgatcatcagttacttttccgtagatcgtgtataatgcgtaaggttccgtatgtgtatctacatattccttaagtgtgatcttgatttcctttgaggcgctaccttcgtaccatctatcgcctccagtaagttcctcgctgtcgaagattacttgagtcgtatcggatgcgaattgtcctccgttcatttcttcatctatgtcttccgtgatgaatcggtattttaggattggaaaatcagttttcttccaatcaaactctccgttagcgtcggtccttacggtatcggtatgcagccatccgtaaggataaattcttgcgtcatttcgattgatacgtatttgggcgttaggtatcggatgatcgtttgtatccacgacttttccttttatctgaaaattggcgtaaggagtgccatattcacaaattatgggaccttctccctcgtcgtcagtgcaggagaaacctaaaagcattaataaactcgccaatacgcagttggcttttttcaacaattgcaagtgcatccttttcatggtgtaaattatttttatttacgattctatttatttgatgaatggggcagcaaaatagttgcatgcgaatgcgtaagaaaatgtgatgactttttgtatctttgccacttcaatgtaacagatcaatttatgagagatttcatacgtattttaaagcgtttcgttcccccttacaaaaagtatatggttctgaacatcgtgttcaatgtactttccgctatcttgaacctgttttctttcgccttgattatcccgatccttcagatcttgtttaagatggatgaggggaattacacctttatggattggaattttaacgcgggaagctgggagtcgtggaaagccttgccggagttgatcaaaaataactttttttggtatgtatccgatctgatagaggtacacggaggttcgttcgccttgattatgttgggaatcttcctgatcgtggcgactttcttgaaagtggcgaccatgtatctggccttttatacgatgatcccgattcgaaccggagtcgttcgtgatatccgtaatcagattaacaagaagattacgcagttgccgttgagctttttctcggaggagcgaaaaggggatattatcgcccgtgtatccggagacgtgaacgagattgagacatccatcatgagttcattggacatgttattcaagaacccgatcctgatcgtgatctatctggtgggtatgatcgctatcagttggcaacttaccgtgttcgtcttgatcctgctgccgttggcgggttacgtaatgggacaagtcggcaagaaattaaaacggaagtctttggaaggacagcaacaatggggattcctgatgagccagatcgaggagacattaggcggactccgtattatcaaggcctttaacgccgagaagaagatacaagaccgctttgagcgaagcaatgatactttccgccggttgacgaaccgtatctatcgccgccaacaaatggcgcatccgatgagcgagtttttgggaaccgttacgatcgctatcgtactttggtatggaggtacgctgatcttgagcgcgaatagcccgatcgacgctcctacgtttatttattatctggttattttctatagcattatcaatcccgcgaaagatctaagtaagtcggtttatgcgatccagaaaggtctggcctctatggagcgtgtcgataagatcttgaaggcggagacggatatccatgacccggaacatccgaagaagatcgccttgaaagagaaaatcagttataaagatgtttggtttaaatatcaggaagcttgggtcttgaaaggaatcaatctggatatccggaaaggaacaaccgtggctttggtcggtcaatccggttcgggtaaaagtaccttggtggatctattgcctcgcttttatgatgtgaataaagggaatatccgtattgatgatacggatatccgtgaggccacccttttcgatcttaggggattgatgggaaatgtcaatcaagaggctatcttgtttaacgataccttcttcaacaatatcgcttttggagtggaaggggctacgatggaacaggtggaggaagccgcccgcatcgccaacgctcacgattttatcatagcgagtgagaaaggttacgataccaatatcggcgaccggggtggaaaactgtccggcggacaacgccagcgaatcagtatcgcccgtgcgatcttgaagaatcccccgatcttgatcttggatgaggccacatccgccttggatacggaatccgagcgtttggtacaagaagcgttggagaacttgatgaagaaccgtacgaccgtagtgatcgcccaccgtctctccacgatccgtaacgcggatgagatctgtgtgatgcatgagggtgagatcgtagaacggggcaaacacgaggagttgttggctttggatggctattataaacgactatgtgatatgcaaagcttttagggtgatactgcaacccgggttgcagtggatcgcctcttcggcttttgatggaaaaacaataacaaggaataatcgtatgaatatgaaaggactttatttgattttgttatcgttccttttcggttgtaatttaccggatatgcagaccgggaaggaggtctcttattattttgaccaaccagcgcagatatgggaagaaaccttgcctttgggaaacggccgtatcggtatgatgccggatggtggtattgagcgggagaatgtggtcctgaatgagatctccctgtggtccggaagtaagcaagatacggacaatccttatgcgtattactctttggcgaatattcgtcgcctcttatttgagggacggaatgacgaggcacaggatttgatgtataaaactttcgtctgcaaagggaccgggagtaatctgggtgacggtgcgaacgctccgtatgggagttaccaattattcggaaatctagtgctgagatatatgtatccgaatgaatcggattctatcgctgagtatcgcaggcggttgaacctaagcgaggctatcgcttccgtctcttttaaaagggggaatgtgaattatcaacgggaaatgtttacctctttttccggggatctgggagtgattcatttggtagcggacgcagatcgggccttgaatttctcattgggtatgaatcgtccggaacatgcgacgatctctttggacggaaaggacttgctgatgcggggacaattgccggacggggtggatacgttggagatgaaagggatgcgtttcgcctctcgtgtccgtatcgtcttgccgaaggggggagatttgaccgcaacggatagtagtttatcggtgcgaagtgcctcggaagcgattatcttggtaagtttaggtacggattatttcgataaagacggtgtcggacaattcttggaaaaatacttatcgcaagcggaatctaaggatttctccaccttgcgccgggaacatacgctcgcttatcgctccctgtttgatcgggtctctttggatttgggaaaaggcgaaagggatcatcttccgatccatgagcgtttggccgctttcgctcaagataagaacgatccgggattggcggctttatatttccagttcggtcgatatttattgatttcctcgacccggcagggattactgcccccgaatttgcagggcttgtggtgtaatacgattcatacgccttggaacggggattatcacctaaatattaatttacagatgaatcattggccagcggaggtaacgaacctttccgagttgcaccttccgctaatcgaattgacgaaacagcaagtccctagcggcgaacgtacggccaaagctttttataacgcacgaggatgggtcacgcatattttaggtaatgtctgggagtttaccgccccgggcgaacatccgtcgtggggcgccacgaatacatccgccgcatggctatgcgagcatttgtacacgcattaccaatatacattggataaggcgtatttgagggatgtttatccgacgatgaaaggggctgccctattctttgtggatatgttggtgcaagatccccggactaaatatctggtgacggcacctactacctctccggaaaacgcttataaaatgccaaacggaagtgtcgtgagtatttgtgccggatcgatgatggataatcagatcttgcgggaattatttacgaataccattgaggctgctgggattttaggtgtggatagcgcgttcgctgctgagttggcggcgaaacgagatcgcttgatgcctacgacgatcggtaaagacggccgtattatggaatggctcgagccgtatgaggaggtagagcctacccatcgtcatgtctctcatttatatgggctttatcccgggaatgagatctcgatagagcatacgccggagttggcagaggcggctcgtaaatccttggaggtccgtggcgatcaaagcacgggctggtctatggcttggaagattaatttctgggcccgtttacaggatggtgatcatgcttataaattgctgggtgatttgttacgtccctgtgtagatgagcatacgaaggaggtgaagggaggaggttcttatcctaatttgttttgtgcccatcctcctttccagattgatggtaattttggaggaacagccggtattgcggagatgctgatacagagtcaatccggattgatcgagttcttgcccgctttgccatccgcttggaaaaatggaagctttagcggtttaaaagtccggaatggcggggaggtgtcggctaaatggacggaaggtctgttgacggaagctcgattgaaagcgatcgttcccggttctttcctgatcaagcttccggcgaattccgcgaacatgagcctcaaaaagaaccaaaagccggtttccctacctgtagtcgatggaaaagtaacagtggacttgttacaaggggaagagtttgtgttgcaattctaagttaccattctgaggggatgagacgcagcatgctgcgtctctacaacaaatgagaaaaatttaatataacggtaatctataaatgaaaccgatcgaaaggcgtgcggtgtcgtccaaagaggcatcgagcgccttcgctcgttcagataggttatattttttacctatggcagtcaagaagatatgtagattatcatcggccatcggatagaactctagtcctccttgatacccccatgccgtacggtattttcctttctcgtaagtatcgtaggctttatagatcgatgcgctttcatacattccttttgcgaatagttgccatttgggatgaaaacgatattgtatttctcccaccagcgaaagataatcgatgttttgcatacgaactggtggttccggttcctcttcctcttctccggcgacttcgggctgagtcaattcggtcaataatcctaacggatctaatttcccccgtgaatacatgacatcgaaataagcatagaccggtccggcctctatactttgaccggtaaagacgctatacatatattttccttgggcttgctctgcggcggatacggagtatcgtaaatgaatcaactcatccagaaagttaccgttccagttcaatgtgtaaaacaagggaactctcggtttcttaaatccttccggcagacgtccatactcatcttccatcgatcccatacgactgttcgtcacctgtaagcggatctcttgtgactcattcggctgataccccagcccgattcccgtaaggtagcaaagggagtattcattcatatcgctatactcataaataagcaaaggattctcgtcgtactcaaaaccaccgtagaacacatcttgttttccggcggttaaggtaaaacgctcattcagtttatagccaatatacgcatattcgatcgactcattcaaattctccaaggcttgtccctcataaccgccattcagcgtttggcgataccaatagaataaccgatcgttcacttctccggtaacatcaattttgacatccctgaaacgaaaggcggcttcatccagcttccccgagaaaaagtccgcgttgaatcctgcatgcatctccaagtccagattgaaaaccttgttgcgtttcggaatcttagttgcgtattcaaaaagagataccgaagaagaatcccgctctgggatcggagaatttgtctgagcgtaagacgttaacgcggaaccgataaataagaaggccgacagccaagccactgtgagtcgtttcatttactgatgttaattattaaagtggccgcaaagatacgaattattgctcggttttgcccatatgcttcatgactttagcgtccagatagaaaatgagttcttccgctatattcgtacaatgatctccgaaacgttccattttccggataacaccggccatatataaccctgccaacgcgctacctttatgctcctctatatatttggcgataatagcggtagaattatgattgatctcatcgatcaaattatccttcaagaagatacgggaagcgatctctgagctttctttctcaaaagcctctttggtgagtgagatcatgcttaataactccgacagcatttcttctacccgggtttccttgaccagttgcgggtcaatcggttccccctcgggaaggtttcctgcgaaacgggcgatgctttctgcgaaatctcccagacgctctaggtttgtattaatcttatacatcgccaatacgaaacgtaggtcgatcgctaccggtgcgtacaaggcgatgatatcctcgcaatcactgtcgatctttagctcgaaagcatttacccggcgttcccggctgattaccttataagcgagttccttatctccggtaagcatagcctcccctgcgttgtataattgctggtgaaccaatgcccacatctcactgatactattttttaaagaatgaatctcctgctctataaccttcatactcttctaattttcaatttttaattttcaattacccaaaccgtccggtaatgtaattctgtgtagactctttctccggattggtgaaaatcttccgggtattatcatattcaatcaattcccctaaatagaaatatccggtcttgtcgctaacacgagccgcttgttgcatattatgggtaacgattacgatcgtataatcatttttcagctcatgtatcaaatcctcgatcttactggttgaaatcgggtccaacgcggaagtcggctcgtccatcaacaagatagaaggcgagatcgccaaggcacgggcgatacataaacgttgctgttgtccgccggaaagagcgaatgccgattctttcagtttatcctttacctcgtcccaaaggacgacctgctttaaagtcttgaccaccgtctcctcaatataattctcatcgttgacaccgtttacccgcaggccataagcgacattctcataaatcgtcttaggaaaaggattcggtttctggaaaaccatccccacgtttttacgtaagcgatccactctctcgcttttcgtataaatatcccttccatcaatcaggatctgaccttccatgcgagtgtccggaatcaaatcattcatgcggttgaacaggcggaggaaagtagactttccgcaaccggacggtcctatgaaagcggtggacgtattcggctctatctccatggaaatgttcttcaatgcatggaaatccccataataaaagtctacgtttttagcatcaatctttatcataattgtcttatttttttaattcatttttaccttcttggcgaaataactacgtaaagcgttcgctaaaaggtttactaataatacgatgacgatcagcacgagcgccgtgccataagccatcccccgggaagcctcgatatctgtaccgcttgtagagataacatataagtggtaaggtaatgccatacattggtcgaaaatacttttcggcaattgcggcaagaaataagcggccaccgtaaaaaggataggagcggtctctccggacacacgcccgatcgaaagaatcaatcccgtaataatattggggaacgccatcggtagcacgaccctgcggatggtctgcaacttcgtagcccctaacgctaggctaccgtgacggaaagaatcatcgatacttttcaaagcctcttccgtcgtgcggatgataagtggcaaggacatcagcgccaaggtaaacgaacccgctataatagagtctccccatcccaaggtacttacgaatagagacataccaaataacccgaaaacaacggatgggacaccgcttaggttattcgtcatgatacggatgaaacggatgagtttcccgtttgtggcgtactcgttcatatagataccactcatgatgccgatgggaaaactaatcaagctacttccgatcactaaatagagtgtacctacgatagccggaaaaatccccccggaggtcatgccctcttggggtgcttgtgtcaggaaatcccaactgatcacgctcgctccctttaagataatgaatcccagtattacgaataagatcactacgaccaaataactcaggaaagaaaagaaaccgaaagcaacctgttgagaggcccgtttcctcttgtctatattccctaaatgttgaataggtgccatatctttaattaaattttacgtttggatgaaatatattctacggcgatgctcaaccccaaggtgatgaggaacaacacggctcccagcataaacaaggcttggtaatgcgctccacctgcgggagcctcacctaattccgctgctatcgtggcaggaattgtccgtaccggttcgaagaacgaggtagggataacggcggcgtttccggttaccatcaatacggccatcgtctcaccgatcgcacgtcctatacctaatacgacagcggacgtgataccggatatggagtaggggattattactttgtagatggtttgccattgcgtggctcccaatgccaagctggcctctttcatggctcgtggggtagttcgcatggcatcttccgctaccgtgatgatggtcggcaacgccatgatcgctaaaaccacgcttccggcgaaagcggtctcgcctaccggaaggtctaaggtcttttggataaggggaacgatcaccaccaatccgaagaaaccataaacgactgagggaatacctgccaataactcgataataggctttagcaaattacgggtttttgtattggcaatctctgccatatagatcgctaccgctactccgaaggggagggataaggcgatcgcacctatacttactaaaagtgtgcctagtaatagagggatcaagccaaagatcggagcgggagcggaggtaggataccatttcgtccctccaaagaactccgaaggtttgatcgtggctcccgatatgatttttcccgtaaagttctccgacttgtattgttccggaaagaatgcgataatccccggctctttatggataagttcattgattttctcgggaacatattgaaattcttcacctagctcttcttccgtataatagttggttaggtccgagaaacggaagacaagtatatcttgattttctccgtttaaatcttcccaattggtgatattggcatcgaagacatccatgatttgctcgggagacaaatgttcgactggattttcctgattcacagccaatatatatccttcctctacctccgggctgttaaaaagacctgcggcctctttaaataagaagacaatgatcaacaagatcgtaaagctactgacgcttccactgatcaagaatcctccttccactaatttttctataaactttctcacaatctttgcctatttattctgctgcaaagaaagagcctctatattaaggagagattaaacccgcttgaaagaattgtttcaaaattattacaaatgtattacgcattgtctgctatgagaatagggcatgagttcggttgaacccatgccctatgaattatgcctgtaatatgtttgtattacttattatacttgttccaatccacattgtgcatatcgccgctggccgctagttcctcatggaaagcgaaacagcatttcaggttttgaggcgtatgtcccttgatacccatagcgaggtattcttccaataacggtttgtaatccggatgaacacaattgtcgatgatgcaacgagcgcgttggatcggagatttaccgcgtaagtccgctacaccatattccgtgataatgatcttcacggagtgctcgctatgatccaagtgagataccatcggtacgaacgcgctgatcttaccctccttcgctgtagacggagtcgtgaagatcgataacatagccgaacgggtaaagtcgccggaaccaccgataccattcatcatacgagtaccggatacgtgcgtagagttaatattaccgaagatatcagcctccaaagccgtattgatagcaatcaagcctaaacggcgggcaacctccggattgttagagatctcttgcggacgaagcaatatcttatccttgaagaaatcgagatttgcgtagatctcacggattacctcattacttacggacaaagagcaaccgctggcgaatttaacgcgaccttgtttcatcaattcgataaccgcatcttgaataacctcagtatatacattgaatgcggggatagactcattagctcccatgcagcccaagactgcgttagccacgttacctacaccactctgcaatggaacgaattctttcggaagacggccggccttgatctcgctaaccaagaagtccgcaacgtttttaccgatcgccatcgtaacatcatccagcggagagaattttccaccttcattcggctcatcggttcttaccacaccaacgatcttagccgggtctacttttacacaatcgttaccgatcctgtcagaaggagtgtagatagggatctcacggcgtaaaggaggatcagccggctcgtaaatatcatgcataccgcggatttctttcgggtgacggcagttcaactcaacgatgatacggtctgccatacgacagatagtaggtaagataccaacacctgaagtcggaacgatctcaccatcctcagtaacatcggcagcctctacgattgcgacatcaatcttacccaagaatccgtaacgcaagctttgtgccaattcagacaagtgcaaatcgaaatattgtgcctgatgagcgtttaatgcggcacgtaagtctttgttagattggtacggtgtacggaatttgatggcgttagcgcgagccaactctccgtctagcttatcaccagtagaagcgccggtaaacataccgatttgaaaagggttacctttagcgtgttcttccgctgccttccgggcgatagctccgggaacgactttcgggcatcctgcgggtgtaaaaccactgaaaccgacattgtcattatgatgcacataagatgcggcttcttcagctgtaataaattttaatgccatgataattagtttttatgtttttaggtaaatacttactgttcaatatttcgggcgcaaacttacataaaattacgctgaatcgaatataagtgtggcgtaaattaatacttccggtttagaatctccgcacaaatgatcgctttcttcaattcctcgatgtctctgaaggtatcttctggcataagccccggttcttcctcgatagcactcatccttacggatggctgggtcgcgatatgattcgggatattcttctcggcggaaaggaatggagatgaggcaggcgatgaggttacgacttgcggtttctcaacctttgactttacctgcttttgtcggggagcgggcttaggtttttgcgtttccttttgcatatcctccaatatctcccagaagccttttccttctgtaggctggtcattaggcacaatttccctgtcgggttgccccaatatatcggggcgactcttcttctttttgtctttcgaactgaataagccactgacggcggcgataatcaggaaaacaatatataaccaatctcctacgttatccataaactttgattatttttgcacctccaaatgtaagaagaataattgagaagtgaaaagatgggagtatataaaacatcagataggtataaaagtaaataagggtaacttcacagccacccttattcgatttaaccaaaaccttaactatgaaaaaatttacgtttttcgaatgcaaatataacggtgggattcgaactatgcaagcgtttgcgtaattatttttaagaatcttgcttatttaaattatattaacatatagtatggtaaatcaagaaaacggtgtggacttaaaatccgctacccaaagcgatgaacgaaagttgtttatcgagacctacggctgtcagatgaatgtggcggacagcgaagttgtagcttctatcatgaagatggatggctatagtatgacggagaatatcgaggaggcggatgccatcttcgtgaatacttgctccgtacgcgacaacgccgaacagaaaatctatgggcggctacagtatttccagtctttaaaacggaaaaagaagtccttaattgtcggtgtattgggatgtatggccgaacgagtgaaggaagatctgatccatgtgcatcatgccgacttggtggtaggaccggattcttatctggacttgccgaacttggtgggagcggtagagcacggagagaaagcgatcaacgtggagctttctacccaagagacctataaggatgttattcctttgaagttaccgggcgtacatatctccggtttcgtgtctattatgcgcggttgtaataatttttgtacgtattgcatcgtaccttatacaagaggacgcgagcgtagccgggatatcgagagtatcttgaatgagatacgggatatgcacgagaaaggctttaaggaagttacgttgttgggacaaaatgtaaactcctattctttcgagaaagaaggtgagaccataaccttcccgatcttgttggatcgtgtggcgaaagaggttcccgatatgcgaattcgttttacgacctcccatccgaaggacatgagcgatgataccttgcgtgtgattgccgcgaacgacaatatctgtaagtttatccatctacctgcccaatccggcagcagtcgcatcttgaaggtcatgaatcgtaaatatacccgtgaatggtatctggaccgtatagcggcgatccgtcgtatcgtaccggattgcgctatctcgactgatttattctgcggtttccattccgagaccgaggaggattatcaagagactttatccttgatgcgtgaagtgggatatgatagtgctttcttatttaaatattccgaacgtccgggtacatatgccgctagccatttggaggataatgtaccggaagaagagaaggtacgtcgtttgcaaggtatgatcgatttgcaaaataagttgtccgaggaaagtaacttgcgggatataggcaagactttcgaggttctgatagaaggattctcgaaacgttcccgtgagcaattgttcggacgaaccagccaaaacaaggtggttatctttgacaagaagaactatcatgtaggtcaattcataaaagtcaagatccataaggcttcctcggcaaccctgttcggggaacctgtggaggaataagaaaaagaaaacgccaatacgttccatttcgagcgatattggcgtttctcttattatcttctatctttggaatatctccgggtatttgttgatgaaataaaccggcgtgcaactccatgcgtggcaataactattgatcgggaaaaatccgtaaggtgataattcgtcattgttcggatcatatacctcccagaatgtatcggctcctttattcaccatgccgccccaataactggttaagagcgaacgggcctcttgccgcattccacatttcaacaaggcttccattacataatgataagcgtacggacatcccggatagcatgcgtcgggcatcgataggacggtggccatcgcttttgctccttccttggcggtaagcgtctccgataggatcatccacacttgtgataggtaagacacctgacggttagggccgcttacgatcaccccgttcttttggtcatagaatgttttccgggcggctttctttatctggccggcgatacgaggccagtctccagcctccttctcttttcccagcattttagccagctcatagcttttctctaatgagaatgccgtaagtccctgcatggatgcttggcgatcataattatctttccagtcgaataccaaccaataaatcggcttcttttgcatatcgtagatccaatcgtccgagtattgacgcaaggccatctctatttggcggaccactaccggccataagtccaaggcgacctccttgtctccggtctctttcaggtattccagcaacgctacgttatacagcagggaatagtccaagcaatgcgtaccgttttgcggatgaggggtcggtgtctccaatacggtggcgtgcagcagtccttcatcattggctagagccgctaataaatagaggcaacgtttcgtcaagtcgtggtttttatacgaccatgcgttcgctagcgcctccagatacaagtctccgatccataaccggcgatcccgtttcgggccatcctcatagacggtctgcatacattcttttaatgtaagcaatcctacctcattgattttacggatcaagggatcggtcgtggaagccagtggcaatggagccgtcttagccgatgtctgcgcacggaacgttagcttgtcgaaggcgaaatcgaaactggaagcgcctagcaactctatcttgagataccgaaaagacacccttctggggatggaggcctcgatgggtacggtcattaacgtcatcacctcatcttgtagccaagcccttgacagaccgcccggataagggtcgaaaggcgtgttcaattccgagggaacttcggcgaacgtgaatttgatacgtaccggagcgtccgaaacctgttggctaaggagcttgagcgagaaatccaaataccccgtcagatgctcaccgaagtcaactataaccgatggatgtttcttcagggactcattgaataacagatccgtgcttccttcgtcccgcatgcgccaaccttggtaggctgacgcatctttgatggaagtgacccgtttgaccggcttatgttccgtataggttaacactggcttgcaggcctcactcttttgaagccatgaagcgctttctttgaaataacgactttgtgctgatagggtgaatacaccgacacagcatagtaaacttagcaggattttcatatgtgctcttttcatgatgcgaatataagaataacttcgttaatatccgggattttgtttaagctcgctgttcaagtcgatttctcgcagaggtatgggcaacaagcatttatctgggttgaacagataagcgttcgccacgggttgaacaccgtcgggccaataataagattcgggatttgcctttatcttttgtccatgtcgtgtcatgacttccacggctcgtcccgttctcagaaggtctgtccagcgtttgttctcgaatgccagctcgatccgtctctcttggtagatagcctctctcaacgcatctacattctgggatttgacaggagctaatcccgcccttccccggatacttgcttgcccgaaggtgtcattcagataatggatagcctcgtccggcctattctgctcgttgatagcttccgccagaaagagcaatacctccgcgtacctgtagaccggccagttgtcatccgtgtaatagggctttatatgctcatgaaaatattttttgataaaaggataagcggttattcccggagctggctcatagtcaactatacttttcacgccggtagcgtcgagggcgtagctatcggtgagcttaccttccaccataccgatggatgcgtccaaccgtttgtctcccttttcgtatgcgttgattagatcgatcgtaggggtgttaaacccaccatggtctacgttggaaggacaaggattaggggttgttcccgtgatggcagacggattcgtcatatagggcaagaatctgtatatgaaatcactttgttgttctaatgaggcgtcttgcatgtattggatctcgaagatagattccttatggttcttgttcgagatggaatagatggagccgtaatccgctaataactcatactcgcctgaggataccacctctttcagcgtttgttctgcttccgcccatcgttttagtaccatgtatacgtttcccaataaggtctgtgcggagcctttggaaactcttcctacctcttgccttgattttacaggtaggagatcactggcttcttgtgcgtctttcatgatttgctcatatacttcgtctacgctcgcacggggtttaaatgcctcctcatacacggtagagggtgtcgtatgcagaggtacgccgccaaagtattgtactaggttgaaatagcagaatgcccgaaggaacaaagcttgtcctttgaggttgctttttgcttctgcgtcaaaatccgcttggtctatttctgagataatccggttacatcgtccgatgattacgtagcagttattatacttcgtaccgacattaccattggtggatgtctcaaggaactgatccggatcttctccgtctaaggatgatttggcgatatggatgatatacgtcgtattatccgatttggcctctcccagattccactcttccgtgttgtacatgttctgtaaaggttcgtaagctccatttacggcttgcctgaaatcctcctcgttctggtagaagttctcggcggtgatctcgctatacggcgtaagattcaagaaatcactacaggaggcacaactacatcctaaagcgatgcttatggctatattgaatatcgttttcatatatttcgtataattagatagttagaagttaacatttaaacccagcgtaatggtccgtggaacgggataggtggtataatcgaatccttgttgcaagctattcgccgttgttcccgtattgctgatattcacctcgggattagcgccgatgtagctagtgaacgtatatacgttctggaaactgacgtaagctcgtaatcctttaatgatatcccggtttcttaacggaacttggtagcctaaggtgatattcttgattgtcaagtagtttccgttataaaggaaacgggaactgaaccagtcacgttctggtgccgtggtacccatcttggtcgttccataacggccgttacccggattctccggtgatttccagcgattgtctaccgctttatacacgttgaacacaccatccagatttccagcgaactgatctaccatattggctaactcaaaaccaaaaccgccggatacgacaattgacaaatcgaaattcttgtaggtgaacgagtttgtcatgcctactatccataaagggaccggattgccgatgatatcgcggtcatccccttgggcaactttgccatccccgttcacatccttgaagcgaatggttccgacatcggcttgtgcgtgtttcgggtatttgtcgaattcttccttgttcttgtagaccccttcccatactaagccgtaaaactgtccgatccgttccccgacttgcgtgatgttgttaccgatgatcggggcgtcatctacacccagttgcaagcatttattgtcattgtaagatatgttcaggtcggtagtccattgtaatttgcctgtcaggttcttggaggatacgcttaattcatgtccccagaacttcagtttgcctgcgttcgactggatgttgtagaagccggaagagatcggtacctctagcgagaacagcagggcgtccgttcgcttgctatagtaatcgtacatgatggataagcgattattgaagaaaccgacatccagaccgacatcgacttgcttattcctttcccagcccagattcgggtttcccattcccgagatgcttctgccgctggccaaggcgttattgaagttgctgttcgtggtggtgatcgtcgccaaatgcgtatagttaccgatctggtcgtttcccacgataccgtaactgatacgggccttgaggaaagagatcgttttctccaatggtttcatgaactcctcgtccgagagtatccagcccgccgatacggatggaaaattaccccaacgattgttcttaccgaaacgggaggaacaatccctacgcatcgctgcgcttaaaaggtactttcctttgtaattatagtttatacggccgatataggataaaagggaccattcgtttatgtttccatccgccgtgatggtaggggcggcattgaatgtcgatattttatcgtcgggaaagttcgttccggtcaccatcgtatattcgctatggtatttttgtgcggatatgccgaacaggagatcaaaggaatgatcttttatctgcttgctgtaggtggcggtattctcccacagccaagtgtagaatagattattggattccttcgcctcggggatctgatagggagccttatagatctctccggaggtggagggcttgaacgagttccatttattctgtgtcaagtccgcgttgatgctggtctttacttttaaatctttgaccggctctacctccaagaaggcgtttgcgatcagatgggtgttctgggtcttgttcttgttgaggctaaccacattataccagttcgggttatcgaacaatcccggcccactggccacaagcggaatactgccatcctcattcttatagggtgcgagaggtgttgtcaacatagctccttgcaggatggaacctttatcttccgtccagttaccgtccgattgcgggctattattgatggagaagctaggcgctaggttcacgcctaccttgacgatcttcgagaatacgtattccgtattggctcgtgcggagaaccgttggtaattagagtttgtcaacactccgtcttggttgaaatagctggctacggtggatgatttaaacttcccgtctccgttgctgtacgacaaactgtaattctggatagcggcgggacggaataatacgtcataccaatccgtgcctttacccagcgcttcgggatgctggtaagcgggatcgaccgccaatccgttctcttcagcgatctctttcctgaaccgtgcgtattcggaggcatccatcatatccggcctccctttctcgggtacgtattgtatgcctccatatacgtcgacgcttagttttttccctgattgggcagtctttgtctgtatcaatacgactccattggcagcccgggaaccgtaaagtgatgtggcagaagcgtcttttagcacactgatactttctatctcgtctggattgatcgtgctgatatcgcccacgataggcattccatccactacataaaggggcgtggttcctccggacagtgacgcttgtcccctgattcgcatggtcattccttgtccgggtttaccggatacttgattgatttggacaccggcgaacttgccttgcatcttttgcgagatctgggctacgggcatatccgccatctcttccgacttgatggattgcacggagccggttaccgcccgcttgatctgtgttccgtacccgactactaccacttcatcgagcttctgcgtgtcttcccgcagctgtaccttgatatgattctctcctgcgccgaccataacgtccttgctgttatagccgataaaagatacttgcagggtttcaccatccgataattcgatcgagaatttaccatctagatccgtgattgtcccattattggtacctttcaccactacgttcgccccgatgatagactctccgttggcgtcaagcacgacacctgtcacttttcttgttctctgttgagttacggaatcatcgttccgctccgtatacgggttctcttgtgatggatttgtagcgatagccaatgccggcgatacgcagaggaagagcaaagacaatgatcccatcgccacattccaagttctcattttacttttcatacttttcatttgttcataattgaatagataatgttaactacatacgataagtctgatagattcagattaactaatacattattagatatactccataggctatatgttataaagttattaagtaccgtaggaactcaatgggtaatttatgtataggatattagaggagagtggtttaggattgattgcggatctgttatgtcatttatctaacaagaaatgtcatttttgtaaccatttgattcttattacttcccatctttgccatatcgaaagagagagatagtaaggatttagttcctacggaactgtggttttttcttgcgtattattttatagtacacgtacgtaaattatgtttatagcttcccttttcataatagcgacagcttaccttgatttttattagccgttcttttgggttcttaatgcattgtactgatatttttctggagtggtaccttgagtatgaaatgaaaaaactaaatcatctaccatatctgccattatctatataagtatctaattataagaaatttgttgaatggtggtagataataaacatctaccactatcagcttgcatctaccactatttactgcttttcaaccactaaatgcagccgttcactattcgctaaccacattactcgttctgcgagggtatgccaacaggttgcctgcttggttatttgtataccttgtgtacggatttaatgtattgaataataggtatttatggttttttaggcataaaacaaaagttttcatagcggaaaacttttgatttgtgcttacgaaactttagttttccctagaagaaactttagttttctctaggagaaactctttgttcccctaagggaaatgtctttcaaaaataacacgttttcttatccaatgcaaagaaaaagtatcaatgtcaagtataagtggtagatgttgaatgataattgtagatgtcaggctatctacaacctatatgtaatgctttgatttataaagcatacatggcgtagtggtagatattgtagatgttttcataaaatcaatattgtagaattccttttatctcaattatgtatagttgcagtctgatatttggttagttatgctattccacatgctttaagaagagaatcttatagcttgtgatgatataaagtttttatggtagaaaattttgtttacgtaaaaatatttgatctataagtattctgtaatagataaaaacgcctagtctaaacgatcgtttattctaggcgttaaagataggctatatttttgaataaaacaaaatccagagaaacttttaaaaattgattatcaacgcataaacgtaaatatggacgcttatgcgttgaattcaataaaacgccagaataaaatgatcgtttagactagtcgttttataaccgatgatttcgcataactgcttgtaaatgatgattatgagaagactgatatgcaggaaactacagagtttatgaatatagggtaaatgttttaaataattgaatattactaacttataaaaattaatcgtatgaaaagaagactactttttttgttcgccgtctttatggtgggtgcaagtgtggggtggggacaaatgatccctacatactacaaagtggctgtaggaacaggtggtgatggatcatctgctggttcacccatttacaaggcaaacttggaagcagcattgtctgatgcggcattatcttcattagatagtgtgatcatattgttacctgaaggggaatactcggctaatgcagctccttattctatcaccaaatcatcattggctatcattggtgaaggtgatacctcaacagttacaattaagtctccggtagatattgagctaacaaacggagggaatgtgtctttccaaaaggtacatctaacagcaaaaacatcgactggacgaggagttgtcgatattaaatcctctaaaacgacagtgtctttcagtgagagtaagataacgatagaggggcggggaacgggtgatagtggttccggggcttgtttcggtatagtgtctcaattaactgtaaatgagaataccgtaaactttatcaactcccgtatgtatatgtctgagggttttgaaagaggacttgcatttcgtgatggtggaggccatacactcaattttataggaagtaagatggaggggccttcagctaaaggtttatatccttacgtgatcggcatttgctcatgggtgggaggaactgataatactaatccggtaacttataatataaggaattctgtagtagatgtgaattattatgcaatatttgccatcaaccaagcggggtacacaaatgccgtaaatataactatcgacaattccagtgtaactgcttgggccgcactttttctaagaggtgatttagtaaatgaagcctacccgcataatgtagcgatctctaatactcatttgtatggacgttcttaccaaaatgggccaagtgatggatttggaactgtcgttttggataattgtcaaaatttgactatgacgatggactctaaaagttctatcgtttcagagaataaagcaccgatagatagccccatcacctatatgtgtgtggctgatgtccgtaagaatacttccggtacttggacgtttacatccaccgatggctctaaggctttaatccaatccaagaatgacaaatatgctcctacattattttttgatgatgcaggaacatatttggaggttttaggggttgaaaatgttgagtttaagactgaaaacgagaagccttgcattgtctcgattcataagaacgggactttgaacaatgcggcatccagtttagacgtattattgacgaatatgattttagaagaggaggataaagtgattttcccggaaggagaatatactttaccaatgacgctgcctctggataaatcaatcacgcttcatggagctgggcaaagtcagacaattgtaaatgggcatatttccgttaattcaccatcaggaggctcagttgcattgaccgtaagcgatatgaccttaaaaggaactgataattcctctgcgcatgggcttattggtatgattggaacgggcaaggatatcgtaaagttaaccaattgtaagttagatggtggtgcggttaccgctcaaaccgctgccgtaggtgtccgtatggaatcagtgggagcggagttaagcttgacgaatacggatatcgatgtcaattattatggaataggcttacggaataaagagcaagtcttagatattacgggaggaacctttaccgcatggggggcgatcatgacatcagccggaagtatgagtccaagtgatggtacattagctaatacgaatacccggataacggcgaaagacgcgacattcatcagtaggactcttctgaatgggaaaagcaatagttatggagctgttattcttcaggaaaaatacaacggagttacagctgatttcacgaattgcgagttgcgagcggtagatggattagatcctttgataaatgctacccaagctacggctacggatatacgttcgtatggaaatacgatcacatttacaggttgtacgttgtcttctttggaaggaacgaataatctcccggatggaagtaacggatatttacatgccggagttattcggctaggttggagtggaacggatgataagtcggaatttgcggataatacgataacgatcaacaattctacattgaatggcaaggagggagagaactgggtctattcacatcgcgaaaaggaggcgaaaaaatacgacaagctgacgatcaatggaactgtttatgatccggcctcgggtcttatttgttatggagagccagatattcagaataagattgataatgcggtagcgggagagacgatttctgttccggcgggagaacatgcgggtttcaatgtcactaccgctgatgtccggataaagggagtttatggaaaaacgattattaaaggaacgaagaagtatacgggttcttccatagcttgtatctctgcggataaggtgactttgatgaatctttctttcaagagttcaacggatggctcgaatcgtccaacagcattgtttgtcggtggaggtacggtggagattgatagttgtatttttgaggataagctactccaaacaggtttatattcggaaccgggtagtactcttaaagatgcgaccttgttggttcataacagtacttttaatgtatatgataagaatttgttgatctcagcgggacgacttaacgctatggtcaagaataatgtttttacggatagtgatatttcggtagcgaagaatgacggctcgaatgtcgttgaatcaaatgagtttcataattgtgtcgtgaaagttgaggatggtgtaacattccaatataataagatgtacccgggcgaccagacatatgtatattccattcgtcccaataatttagagggaacggttgttgcgccgaataattattggggaagtgataatccggatttttctgccttgattgataaaagcagggcaccgaacggatctgtagattatttcccctattattcggatgtcgctttgggtaccttaatctataagatggtaacgatttcggaagatacggtctgggccactccgcatccaaatcaaaaggtcaccgtcttggatggcgcgactttgacgttgtctgttccaatgtctttagataccgttaccatgagagaaggtgcgcaaataaagtcaaatcttgcggatcaaacaggaagcgtgaccactaagtctcttcgtttctctccggatctctccggtactgagtggaaggcgttaggagtgccattagcctctgccgtgatcaagaactctacggaggaggagatctcggctccaagtgttcaaaatgttgataatggtatctggttcgctaggctgaaggataacaagactccggagttcgtggtggatgagagtgcttttggcatggctggtctttgggcggctaatggcgatacctatacgatctcttctgaaggagcttttgaattcaagaccttggaagaacctgccgctccaactgaaacaggtactttcttgatgtgctcgaatccgaatacatttacgattaccttgaaacaatctgcttatatattgacaacggatggaacctctttcgagcaagaggcaaatccggagatcaagcctttccaaagctttgtcttgacagacgccaagacattgagtacgcttcgctctttacgtatcggcgatggcgtggttacgggcaaccagacgatcgagccggtagatggttattacgtgactaccgatcgtggcgctatcgtgattcacacgccggagcctatggacgtggtggttatcagaatgaatggcaaggtcgcttatcgtggcgaggttacggacggacagcggatcatggttccttcgggcatctatgccgtgaacggtcaattagtaagggttaaataacgattaaaacaaagataaacatgaaaaagagtatattagcgatattccttgctgtcattgcgatggcacaggtacatgcgcaagattcagatttacgttccgccccggatcttccgacgttcaaggtgacattgaattatagctcggcgaatacggatcaaggaaccataatcagtacggtagccacaggttccaaggtggcatataatagtaaacccgttttcacgatcacggcgaagcccggatatgtcctgtcggatataacgatgaatacggctactattggcacgttaccgagcggtacttttcaaaatgataatacgaccacctattcctatacttccaccgctttgaccggtagtacggaaatcaaggcggtgttcaaggcaaaagagcaggtgacagtcacgatctctcctgagtatgccaccttggatgagataagggcgaaggtgaatttgcccaaggttacttttgacccggttattacggggtataaagtacaatacagggaggatggctctgctgctttgacggatgagttacccgaaaaggctggactttattatgttgtcgtaaccaagtcggagactgatacgcaagccgccataaacaaggagattctattcaaggtacaaccgccccatacgctttcttactcgtttgaggaggcgcaaggatctgtaaccgcttctatggatggctccattatcgccagtggtgatgagatcgtttataataagccagccgtattgaagattgcctccaagcccggttatgtgttgagtagacttaccgtagataataatgaggtgactttgccgaaaggaacttttaattcttctacgaatgagacttcctacgcggattatacgacatcggcgttgaccgcttctacggttattgacgtgcgatttgccgcgaagaaaaccgtatctgtaacagccaatccattatctgccacgaaggatgaggttttggctggtaagaatcttccggttattacattttcccccaatacgatagcggggcagaaggttcaatataagaacgcttccggagctttatccgataaacttcctgcggcggatggtgtttacacggtcgtcgcgaccagtcccgagaccgcggaatatgccgccttgaaggatgagaacatgaagttcacggtatctaaagcgaatgtattaaattataacgtggaaacggccggacaaggtacggttaccgccaagatgggctctacggacatggcaagcggtagcgagatcattaacgggcaacctgccgtatttacaattatcgctaaccccggatttctattgaataagattgttgtgaatggaaccgcggtatcagccttgccaaaaggtgcgcttaataaggataacaccatctcttatacctatacgaccgcctcgttaaccgcctctacgaccttatcggtaggtttcgccgcaaagaaaacgattgctgtgaatgtaacaggttcttcggcgacaaaagatgagatcgtggccgggaagaatttgccggttattaagtttacgccggaaatagcgggacaagcggttcgatatcgtgcggccgatggttcggagacttccacgttaccgcagatagtcggagcttataagatcgtcttatttagtccggagatcatggagtatgccgcgttagaggattcctctaaaacgtttacgatccgtaatgccaataccttggcttacgctgtcgatggtggacagggcacggttaccgccaagatggataacaaggacatcatgagcggtggtgagatcgcttacggtaagcccgtcattttctcgatcgtatcgaatgccaactataggctaggggctattaagcaagcctcttcggatgtggatatctcgaagatcaagggaacgtatgctaatggaaatacctcttacacgtacacgactcctaatctgatgagtggcgatagctatacttttgcgttcgtctccaaggatacggtgaggttcgtggctaacaaccttgtccagacggtcggctccatcaagccggtcacggtaacaagtgctgtggaggatatcaagatcgaatatcaattgagcggtaaggcttgggttacgacattgccttccacgctggccgtgggttcttataaggcccgtttgagccgtgcggaggacttgacataccgtagcctctctgatacggttacgttagtggtggagagcaagaaagaggtggagagtttggtgttacctactccgggtcgtattgaggaaggacaggctttatcggcgtgtaccttgatcgatggaacttcttccggatcatttatctggaaaactccgaacgagatcgcttctctggataagaaaaagtacgacttgatattcgaaccgaatgatcctgttctctatgcggctaaagatacgtttataaccttgaacgtaattcctgtttattctatgaatgttaccgccggtaatttcggtactgtcatcttggaggggcgtaccgcaaatgataaatacgcgagaggctcggttttgaaagcgacagccgttgcggataagaattaccggtttgccggttggagtgatgggaatacatcggctacacgggagttgcaagcgaatacgaacttggatatcgtagcccgtttcgattcgatcgtttatggcgtgacgtttacgaatccgatgaatggttccttgaaggtcttcgcgaatggcgtggaggtaaagaatggtgctgagtttttgcagggaaccttattgactatcacggcgactccggatccgggctatatggttcagtccgtgaaggtgaacggggctttggtgaataacggttcttatactttgatacaagccgctgatatatcggccgatttccttcaaaaagaaccggataaacatttggtaaaggttggggagttgaagaatggtagcgtgaatctgatcgaggtggatacgaaggcacccgttactcccggtgaggctatctctgaaggtgtgaaagtgaaggtgataggaaatgcggattatggctatgagctggcatccgtgaaagtggaaggcgcgaattataatgaggctgatggctcatttatggttgggaccggagatgttacggtgaacgcgagtttccaattggtgaaatatcaaataacctcggcgttgaatatccccaatgcgggtaaagtcgtattgaaagataaggccggtaaagaggtggcttccggttcaaaggtaccttatatgactcaactgaccgcttctgttgagacggaaacgggatatcgttttatgaatatgatggtgaactcttccgagatcaaggatggagacgtattcaccgtttctggccctatggttgttaccgctaattatgtggagaagaaagatttggcttcgctgattgataagacgacgcaaacggtagtctataataagcaataccggaatttcgaggttaagattacgggctattccggtttggactttaaggtcgcatattcccggagtggggtagaaatgacagagaatcctaaatcggccggaacttataaagttcggattacccgtggcgaggatgatttatttaaagccgtggatgtaactgccgagctgattatcaagaaggctggtatggcattgctgaaagaaccgactatagaaggggaggattattcaaagattgacgctaaacttactcaagacttcgaggatgtggaatggaatccttctacacaaaaatcggcgcttcgtgcgaacgtgactggaagcccgacaaaggatcaggtaaatattctgcgctttaccccacttgacaagagtaattatgaatcggtagattattcaatgccggttggtgaagtaaaaacgttttctttaagtgcctcaaatacggaggttacgaatggaggcttggttattagcgattattctaaaattccggagaatacggttataaagttacgggcggtagctcctagcgagaatcagcgttttgattcttggggtgaaaatgtctcaagcaccgatagaaagaacccagagataacggttactttggcggctgatgcgacatacaccccgaattttgtggataaacctaaaataacggcgaatccttcagatttggagtttgtttataatggttccgtaaggcttgtggaattgaaagacattttgagcggtagttatccgacagatgtaaatattaaatattcaaatacggatggatcggttgctaccccattgaacgcaggtacttatcttgtgactgtaacacgtaccggggacgagaactggcgatctttcgaggcaaccaagaaattagtgataaagaaagcgaaggtcgtagaggtagtagctcctaccgcatctacgatcacggaaggtcagtccttgtcggaattcctattatccggtggtgttgcgaaaggtgccgatggaactaccatatccggtaaatttgaatgggctgatgcgtcagctatattgaaacccggcgatagccagaaaaaggaagtgatcttcacgtcgtatgatccgaattatgaggatgcgactacgaatgcggaggttacggtgaaaagttcggatgcgttagttgtcacgttcgctcaaccggaaaatggttctttgaaagtctatatgttgaaaggtgagggcgagaagaccgagataacgagtggaaccgctgtggcgaaagcgactaagctaaccattgagacagaagccaatccggattatgaattggccgttattcaaataggcgaagagaagtatacgacttcgcctgtagagattgaagtcgataagtccttggctattatagcagagttcaagccggtttctacacctccgggaacagatgtggctgttacgggagtttctttgaatatcacgtccaaggcattggccgtaggtgaatcttttgccttgcaagcgaaagttacccctaataacgccactatgaaaaccgtctcttggagtagcagcgacgagacggtggctactgttgacgcggatggtgtcgttaccgcattgaagatcggtacttgcaagattaccgtggctaccgatgatggaaacaagacggcgtcttgtgtggtaactgtctccggtacggtaggtatcgagcaaatcatcgacgatcatcaaatctattgcgagcgaggtgcgataaccgttcatccggcctgtccaatctcgatccgtatcatagcggtgactggagttagcctgtatggcgactcaattatcggacctacccgcatcccggtatcgacaggaatctatctgatagagatcaacgagaatggcaagcatataacagtgaaagtaaacgttcgctaacaaccttattttaagaaactaacccttgagtctttaatgttggggaaggccgctaggaatactcagttccggcggtcttcttttttatcattgtatatgtacgaatagcctttgttagagttgtagaggttaaatattctaaaaccctttcggcttacttattttattcgttcttttgcaagaaaattgggaggtgtgttctctgtacgcatctccttaatttatttaacgttaataagtgagagtctgatggctgaaaataaaaaagttagttctgtttctttctttaactcccggcttacgtctgttattagtatctccttggtactattcttgctaggactcattctattgatagggatgttgggtaataaactctccgtttatgtgaaagagaacttatctttctccatcgtgctgaaagataaccaaaaagaaactgagataaagaaaatgcagaagagcttggatgctcttccttttataaaatcaaccgagtatatatcgaaagagcaagccgcgaaagagttggaggaagaactgggcgagaatccggaaatcttcttaggctttaaccctttacaggcctcgattgaggtgaaactgcattcggagtacgccaaccccgatagcctccaagtgatagagaagaagattagaaactatacgtcggtctcggagctgctttaccgaaaggatatgatggagatagtccataataatatgaagcggttgggcttgatcctgcttaccttggcggcggtactgatgattatctcgttcgtgttgatcagtaatacgattcgcctgttgatttattccaaacgattcttgattcatacgatgaagctagtgggggctacttccggctttatacgtaggccttttgtgaaatataacatagtaagtggcattttcgcctctatcttggcaatattgatgctaaccggagcgttatattatttgcaaaatgaattgaaaggttttatccagatattggatatgcaaacattattattggtttatgtggcagtgtttgctttaggtattgtcttgtccgtgatcgcgaccatttttgccgtgaataaatatttgcggatgggggtcgataagttgtattatatttaatgtacgaataataaagagttgagaaagatggctaaaagagattttgctttcggaaaagagaattttatactgattgcggtagcggttgcctgcatcgtgcttggtttcatattgatgagtggtggaggttccggggataatacgttcaatcccgatatattcagcgcccgccgtatcgtggtagctccggtggttacggttatcggtttcgtgatgatgatttttggaatcttgaagaatagcaaagataaagaagtaacagaatgagttggtttgaggccttgatactgggtatcgtacagggattgaccgaatatctgccggtgagcagtagcggtcatttagcgattggctcagctttgtttggtatagagggagaggagaatcttgcgtttacgatcgtcgtgcatgtggcgaccgtattcagtacgttagtggttttatggaaggaaatcgattggatattccgtggtttatttaaatttcagatgaacgcagagacgaagtatgtgatcaatatcttgatttccatgattccgatcgggatcgttggggtattctttaaagatacggtagaacaaatctttggatcgggtttattggtcgttggttgtatgctgctattgacggcggctttgctggcattttcgtattatgccaaaccacgccagaaagagtcgatctcgatgaaagacgcttttattatcggtctggctcaggcttgcgccgtgatgccgggtttgtctcgttccggatcaacgatcgctaccggtttgttattgggaaataataaggcgaaactggcccagttctctttcttgatggtaattcctccgatcttaggagaggcgttgctggatgtgatgaagatggtgaaaggtgaagatgtggctggggacattcctgcgttatcattagcggtaggtttcatggccgcttttgtttccggttgcgtggcctgtaaatggatgatcaacatcgtgaaaaaggggaaactgatttatttcgctatctattgtgcgattgcgggattggtgacaattgcttgtacattacttaaataaagaatggattttatagctggagagattttatattttaataaaccgctaacgtggacttcttttgacctagttaacaaatttcgctataagctaagtcggaaactgaaggtaaagaagattaaagttggacatgcggggacactggatcccttggctacaggtgtgatgatcgtttgtaccggaagggctacgaagcgaatcgatgagtttcaataccagacgaaggagtatatcgctacgttgaagttgggagagactaccccgtctttcgatttggagaaagagatagacgccgtgtatcccacggaacatataacccgtgagctcgtggaggaggttttaaagacattcgtgggtacgatccaacagattcccccggtgttctccgcttgcaaggtggaaggtaagcgtgcttatgagctagctcggaaaggggaggaggttgaactaaaatccaagacattggttatagacgaactggagttgctggagtgtgatttgcctgttataaagatacgggtggtatgtagcaaaggtacctatattcgtgcgttggctcgtgatatcgggaaggccttggattccggcgctcatttgattggcttggaacggactcgcatcggagaggtaaccttggatatgtgtatgtctccggaggagatcgatgatttcttagagcagaatgtggtaaaaatagaagaagaaaaataaatagagtgcattatgaagctttcgaaattcaaatttaacttaccgtcggaattaatcgctttacatccggcgaagaacagagatgagtcgaggttgatggtcgttcatcgtgatacgggtgagatcgagcaccgcgaattcaaggatattctagactattatggaaaaggtgacgtgtttatctttaataacacgaaagttttccccgctcgcttgtacggtaacaaggagaaaacaggggcgcgtatcgaggtgttcttgttgcgcgagctgaacgaggacttacgtttgtgggacgtattggtggatccggctcgtaagatccgtatcggtaataagttatactttggcgaggatgattccatggtcgcggaggtaattgataatacgacttcgcgtggtcgtacgctccgtttcttatatgacgggaaccacgacgagtttaagaaggctttgtatgccttgggcgagactccgctgcctaagtatatcgaacgtgaggtggaaccggaagacgaggatcgttatcagaatattttcgccgcggaagaaggtgcggttgtggctcctgctgcgggattgcattttagccgtgagttgatgaaacgtttggagatcaaggattgccagttcgctttcttgacattgcattcgggcttgggtaatttccgtgagatcgacgtggaagatttgacaaagcataaaatggattctgagcaaatggtcgtaaatgccgatgtagtggatatcgtgaacaagggaaaggatgaggggcacaaggtttgtgcggtcggaacttccgtgatgcgtgcgatcgagacggccgtaagtacggatggtcatctgaaagagttcgagggctggacgaataagtttatcttccctccgtatgatttcagcgtggctaccagcatggtgacaaatttccacatgccgttgtctacattattgatgatgacagcttctttcggtggttatgagttgatcatggacgcttacgatatcgctttgaaagagaaatatcgtttcggtgcttacggcgacgctatgctaatcctttaatccggtttctatggcgacagcttaccttggattaggtacgaacgtaggtaataaacgaggaaatttggtgacagcggcggcgctgttggctgaaagggtgggagatgttcttgccctttctgatatgtatgagacggagccttggggatttgaatcggacaacactttcttgaacgccgtgatcgttatgacgacggaactttcccctatggaattattagacgctacccgtttgatcgagatcgagatgggacgtatcgaaaaaagtgacggtgcgtatcatgaccgtatcatcgatatcgatctgttaatggtggatgagcaaatcctgcatacggagcggctgacgctaccgcaccctctgatgcacaaacggtcgtttgttatggaaccgttggcagaagtagctccgttggtgaaacatcctgtgtttggcaagacgatgcgtgaacttttatccgaattataagttttaattatgaactacgagatttgagttatgaataaagaaattaataaagcgatgacgcaagggatcgtcttcaagaaagcgaaaggcgaagcggaagattcgaatggtaagaaaatcaagttctctgatttcttgaaagggacacatggctctgattcagcgaaatggaaggccggttttaaatataaaaaagccttacgtaattccaaaaagaagaaataattttcaattttcaactttcaattctcaattattgcgtatctttgcgaatgaattgacgtggatagatttgtattgcttgcaaccacgggaaaaaatgctaaaaacatatccttttcgttgccgtccggcagaaaaatccttccaagttcaattcagtcatagattaataactaacgagcattgtcaattgcgacctgtggtttatcccctaattctcaattttcaattctcaattttcaatttaaaacgatgagttatttattcacctccgaatcggtgtctgaagggcaccccgataaagtagccgatcaaatatcggatgctttgctggatgagttcttggcgtatgacaagaattcgaaagttgcttgcgaaacccttgttacaaccggacaggttgtcttggctggagaagttaaatcaagtgcgtatgtggatgtgcaggaagtggcacgtggcgtgatcgagaagattggttacacgaaaagcgagtaccagtttgaagcgaagtcatgtggtgtgttctcttctatccatgagcagagtggcgacatcaaccgtggcgtagagcgtgcggatccctatgagcagggtgccggcgaccaaggtatgatgttcggttatgctactaatgagactgagaattatatgcctttggcgttggacttatctcatagtttattatgggaattggcgaagatccgtaaggaagaaccggatttgatgccttatttgcgtccggacgctaagagtcaggttacgattgaatacgatgataacggtaagccgttgcgtatcgatacgattgtggtatccacgcagcatgatgagtttatcggtccgaaaggtatttcacagaaggaagcggatgaggctatgcaaaagaggatcgccttagacgtgaagaagatattgatacctcgtgtgaaggctcaatatccggctcatgtacaggctttgtttaatgataatatcatttatcacgtgaacccgaccggtaagttcgtgatcggtggtcctcacggtgataccggtttgaccggccgtaagatcatcgtggatacatacggtggcaaaggtgctcatggcggtggtgctttctctggaaaggacccttctaaggtagaccgttcggctgcttatgccgctcgtcatatcgctaagaatatggttgccgccggtgtggcggatgagatgctggtacaggtgtcttatgcgatcggtgtggctaaaccgatgaatattttcgtgaatacttttggccgtgcgaaggtgaatatgacagacggagagatcgccgcgaagatctgggatatcttcgatatgtgtccgaaagcgatcgaggagcgtttgaaattgcgtaacccgatttatttcgagaccgcttcttatggccatatgggacgcaaaccccagacggtgacgaagacattctcttcccgttatttgcagaagccggttacttgtgatgtggagttattcacatgggagaaattggattatgcagataagatcaaggacgtgtttggtctataaaaaataagtggaaaaagtaagctggcttaaatggcgaagtatgttaagatactttgccatttaagttaagatacttagccgatgaagttaagatactttgccaagtatgttaacttacccttcctcttggagcatttctacttcttttactttcctgaacaggtcggacgcaaagatgaaatcgttcaacgcttggttattagaggtgattacctgctcttttgttccttgccattccttcacgccttccttaataaagatgatattatcaccaatattcatcacggagttcatgtcgtgggtattgataacggtcgtcatattgtactccaccgtaatgtcgtgaatcaaatcatcaatcaatagagaagtcttggggtctagtccggagttcggctcatcgcagaacaggtatttaggatttagggagatcgctcttgcgatggcggcacgtttcatcatacctccactgatctcggaaggatatagatgtccagcctcggacaggtttacacgttccaaacagaattccgcacgtttcctgcgctctttcgttgagtctttagagaacatatctaaaggaaacattacgttttccattaccgtcatgctgtcgaataaagcggaaccttggaacaacatacccatttcccgacgcagcatatttaactcatacttgttcatcgtgatcaagtctctaccgtcgtataatatctgtccggtatcaggtttcattaacccgatgatattcttgatcattaccgttttacccgaaccgcttcgtccgatgatcagattcgtcttaccatcctcgaacgtcgtacttatatctttcaagacgacacgtccatcgaaagacttcgttatattcttaacttcgatcatttttaagtaagcattaaatgggttaatattacgtcggcaagtaaaatcatgatactgctcatgaccacggcattcgtacttgccttacctacctctagggcgcctccctttacgttatagccaaaataggcagcgatggatgagatgatgaacgcatatactacggatttgataatagaataccaaatgtaaaactcgttgaagtagaattgcaaaccgtactcgaacgaggaaggagtcattcccgtactcgttgagtaactggcgaatatgccgcccatgataccggtgaacatactgaagataaccaataccggaataaagatcatcaaaccgagcattttcggaaggatcaggaagttggctgaattaacacccatgatttccatggcgtctatctgctcagtgactcgcatggttccgatctcggaggcgatattactgcctactttacccgctaggattagtgccatgatagaggaagagaattccagcaagataatctcacgggtggtatagccgatcgtaaacttaggaatcaagggggaactgatattcaaggagatctggatggcgataaccgtaccgataaagaccgagatgattatgacaatccaaagagaatccacgcctagcttgtatatctctttgatcaattgcttaaagaacatactccaccggtctggaagtgttatactcttcatcatcagtagggtatactcacccattctgtgtaatgctttattcatttttatcttgataaatttctgatttcaatttgcaaagatagcgtaaaatccactaataaccatataacatcttagaaacaagattggttttatttgtaaatcctatggtattaaagtttgccacatccctcttttttaactatgtttgttttcttaaatactaaaaaatacttttatgaagcgaattcttttaggagtgatcggcttgctgtgtttatgtgtggcttgcctgcggaaggatctttcttttaagccgggggaagtttggccggatgataaaggggtacatataaacgctcatggtggcggtattctacgggttggggatacttattattggtttggtgaacataaaacggagggctcggctggaaatctggctcaagtaggcgttcattgctattcgtcgaaagatttatataattggaaagacgagggaatcgccttatcggtcgtgccggatgatacgacgagccatattgttaagggatgcgtgttggagcgtccgaaagtgatttataataaaaagaatgatcaatatgtaatgtggtttcatttagagccgagaggtgctggctattcgggagcattgagtggagtggctgtcagtaaaaacgtggcggggccttactcgttcgtaaacgctttccgtccgaatgccggtttttggccggttaatgtacaggaactacataagcaaccttgtacgctttccgcagatctacgttttagcggtggagagttacctgcccatccggatagcttgaatttattggggcgtgaccaaatctccggacaaatggctagggatatgaaccttttcgtggatgacgatggcatcgcttatcatatttattcctcggaagagaatagtaccttgcatatatcgcagctgaccgatgattatacgagttattccggtaagtacgcccgtttcttcccggggcgtttcatggaagctccagccttgttcaaacagaaggggaaatattatttgattatgtccggctgtacgggctgggctccgaatgcgggacgatcggcggtcgcttcctcgatttggggaccttggaaggaattggaaaatccgtttaggggagagaactcggaggtgtcgttttattctcagagcacgtacgtattgcctgtacccggccatgcggatcgctttatttatatgggagatcgttggactccggagaacgctatagacggacgttatatctggcttcctatccgattcgagggggagcaacccgtgatcgagtggcgatctgagtggagttattaaattctcttatcgcttttttgcgaatgtatgtgatgtagatctgcggattatcacgtacattcgcgttaaatttttaagtagcttatgtcagacgaacaacgaatggtgctccgtacggaggacttggtaaagaaatataggactcgtacggtcgtgaatcatgtatcgattaacgtgaaacagggggagatcgttggtttgcttggtccgaacggagcgggaaagacgaccaccttttatatgacagtaggtttggtcactcctaacgagggtaagatcttcttgaatgacatggagattacgaaattcccggtctataagcgggctcgcaacggcattggctatctggcgcaagaggcttcgattttccggaaaatgacggtggaagataatatccgctcggtcttggagatgacgggacgtagcattgagtaccaaaaagagaaactggaaagtttgatttcagagttcggtttgaataaggttcgtaaaaacttgggagaccagctttcgggtggagagcggcgtcgtgcggagattgcccgctgtctggcgatcgatccgaagttcattatgttggatgagcctttcgccggtgtagacccgatcgccgtacaagatatccagacaatcgtggctcgcttgaaacataagaatatcggaatcttgattaccgaccacaatgtgtacgagacattgagtatttgtgaccgggcctatctcctgttcgagggaaaagtccttttccaaggaaccgccgaacaactagccgagaacgagatcgtgcgcgagaaatatttgggaaaagactttgtgctgcgtaagaaagacttatagcagtcgtttcaatcgcctgtttacctgtatgaacagcaggaaagataaggcggcgataagacaaaagtccaaaagatgctcggcgggaatatcgcctgtgataaactcgttatccttgagacgactgtccgacatccctattacggcgaaagcattattgacaaagtgggcgaacaccggtatccagatgctcttgctccaatagagtagatagccgaaataggctccgagtatcatccggggcaagaatccgtaaaattgtaaatggaaggcgctaaatagtatggcggcgacccatatgatcgtatgagggttggaggtccatttcccgatcactcgttgcaaggctcctctgaacaggaactcctcggttatcccggccgtaacggcgataacgataaggttggccaggattacccaaacgctatcgctggataacaggatcgtcgtcagttgttcggcgagggtttcttgcgcccgcatccattcctcgataggagccataaacgcgggtaactccatctgcttgttgagcaatcctagcaaattgataaccggagaaaataagaacacgcaaactaaggtgagaatccagatcctgccgtctgtgattttcttgactgatagataatggcagggattgtcactacatatccaagccatggcgatagatggtagcaaaaaggtacagatcgccgagatgaactgaatgagcctcattaaattagcgtcttgggttatatcagcctgtaaaccgtgggtcgcaagtaataagcccgtggatataatagatgataaaatggctccagccaataagaatagcaagaggatcaaaagttggattatcgccggacgggtagcatatattccttttattctcataatgattcattcaaagggtaaataattgccgccaaatataaacaaaagaataaaaacagatcaaaatttgcacgattaaaagaataagtctaattttgcgacctaaaattcgatacgactattaattaaataaatcattcagaatgaacgtttcgcttaaaaacaatgatgccgtaagcggtatcgtgaaattagaaatagtgaaagctgactatgctgatcaggtagacaagagcctgcgtagccttcgtcagaaagccaatgtaccgggtttccgtaagggcatggttcctatgggcatggttaaaaaaatgtacggaaagcacgtgctggtagaggagataaacaaattagtttctgagaatctgttcaagtatatccgtgagaacgatttgcatatcttaggcgagccgatgcctaacgagactgagcaaaagccgttggatttcgataaggaagaggatttcgaattctgttttgacgtggctttggctccggagatcaatatcgagttgagcaagaacgataaacttccgttctatcaagtcgctatcgatgaagaaatgctaaataaccaagtaaacgcttatcgctcaaacttcggttcttacgacaaggtagacgaggttgaggaaaaagatatggtaaaaggtacggtagccgagcttgagaatggtgccccgaaagaaggtggtatcgttgttgaggatgctgtcttgatgcctatgtatatcaaggatgaggaagaaaaagctaaatttatcggtgctaaagtaaatgccgtagtggtattcaacccgaataaggcttacgagggtgctgaggcagagatcgcttctttcttgaagatcgataaagagaaagtggctgagactacaggcgactttagctttgagatcaaggagatcacccgtcataaagacgcagagatgaaccaagagttgttcgacaaggtatttggcgagaacgtggttaccagcgaggaagaattcaagaacaagatcaaggaagctttggcagagcaattcgctcctcagagtgacttcaagttcttgacggatactcgtgatatgttggttgagagagctggcgagttgaatttcgctgacgatttattgaaacgttggttgcttgccgctaacgagaagaatacgaaagagaagatcgacgaggacttccctcagatccttcaggatttgaaatatcagttgatcaaggagaacttggttaagaagaacggcttgaaggttgaggacgctgacatcgagaacttcgctaaacgtgtggctaaggctcagttcgctcaatacggcatgttgtctgtacctgaggacgtacttgacaactacgctaaagacatgttgaaaaataagcaaacacttcagaacatcatcgaccgtgcggttgaggagaaattggctgcttggttgaaagagcaagtggaacttgatgttaaggaggtaaccgctgacgagttcaacaaactttttgaataaaaagatctttactcggcctcttaggaggttgttttatatcaaaaaagggatttctctctaaaaatatcttagcggatagcgaaataaattgtttctttcagaaatttatttataactttgtttttccgttaagtcacagagggaaatccctttttacgtcttctcggtaaataaaagataggagaaaatatggaagattttagaaagtatgctacaaagcatttaggtatgagtggtacggctctggatagttatatgaacatctccagtagctatatctccccgacaattatagaggaacgacagctgaatgtcgctcaaatggatgtcttctctcggttgatgatggaccgtattattttcttgggcacgcaagtggatgattataccgctaacgtgattcaagcgcagttgttgtatctggattccagtgatcccggaaaggatatctctatttatatcaattcgccgggtggctctgtatatgcgggctacggcatttatgacacgatgcagtttatctccagcgacgtatctacgatttgtacgggtatggccgcctctatggcgtctgtcttattggtggcgggaaccaagggaaaacgtttcggcttgaagcactcccgtgtaatgatccatcaaccgcttggcggcgtacaaggacaggcttcagacatcgagattaccgctcgcgagatcttgaaggttaagaaagaactgtacaccataatctcggatcattcaggtagaccctatgaggagatcgagcgcgatggcgaccgtgatttctggatgaccgcggaggaagcgaaaaagtatggcatgatcgacgatgttttaacacgtaaataacaaaaacaacaataagaaactatggccaaaacaacaggcgatacatgtacgttttgcggcaggagtagccgtgatgttaatttgcttatcaatgggatctctggttgtatttgcgatgattgtgcccggcaggcgtatgagatcgtaaaggagcagacaggaggtaagaaaacttcttttggtttgaagcagaaagatctgcctaaaccggaagatatcaagactttcttggatcagtacgtgatcgggcaggatgacgcgaagcgttatctgtcggtatcggtgtacaaccattacaagcgtttacttcaaaaggttaccgccgatgatgtagagattgagaaatctaatattatcatggtgggcgctaccggtacgggcaagactttgttagcccgtacgatcgctaagttattgcatgtcccgttcgctatcgtggacgctacggtacttaccgaggcaggttacgtgggggaggatattgagagtatcttgacccggctattgcaagcggcggattatgatgtggaggcggcccaacggggtatcgtcttcatcgatgagatcgataagatcgcacgtaagagcgataatccgtctatcactcgggatgtcagcggtgagggtgtacagcaaggtttgctgaaacttctagaaggatcgatcgtgaatgtgcctcctcaggggggacgtaagcatccggagcaaaagatgattgcggtggatacgaagaatatcctgttcgtttgcggtggtgctttcgatggaatcgagaagaagatcgctcaacgcttaaatacccgtgtggtcggttattcggctagtttggatacggctaccgtagaccggaataatttactgaaatacatcaccccgactgatttgaagtcgtttggcttgatcccggagattatcggtcgtttacctatcctcacgtatctgaatccgctggatcgtgatacgcttcgtaacatcttgaccgagccgaagaactccattatcaagcaatacgtcaaattgttcgatatggatggcattaagctgacgttcgatgagaaagtctatgagtttatcgtggataaggcgcttgagtttaagctgggtgcccgtgggttacgttcaatcgtagaagccgtgatgatggacgctatgtacagtatgccatctcaaaaagtaaaggaactccatgtaacgttggagtatgcgaaagagaaatttgaaaaatcggacgtgaaccgtttacaggtcgcgtaaacgtaggcggtttactataaataatacgaagtatggcaaagaaggatcatttaacagaagagctaaatcggcactttggcttcggtacctttaaggggaaccagaaggctattattgagaacgtgctggccgggaaggatacttttgtattaatgccgacggggggaggtaaatctctttgttatcaattaccatccatactaatggaaggaaccgcgatcgtgatatctccgttgatcgctttgatgaagaatcaggtggacgcgatgcggaatttcagtgaggaagatggggtcgcccattttatcaattcctctttgaataagtcggctatcgaccaggtgaaatcggatatattatcaggacgtaccaagttgctgtatgtagcaccggagtccttgaccaaggaagagaacgtggattttctgcgtcaggtaaagatctctttctatgcggtggacgaggcgcattgtatctcggaatggggacatgatttccgtccggaatatcgaagaatccgtccgattatcaatgagatcggtaaacgtccgttaatcgctctgaccgctaccgctacacctaaggtgcagcacgatatccagaagaatctgggtatgatagacgctacagtctttaaatcatccttcaaccgctctaatttgtattatgaggttcgtccgaaaggaacgaatatagaccgcgagatcattaagtatattaaagccaacgagggtaaatcgggtatcgtatattgtttgagccgtaaaaaggtggaggaatttgccgacatcttgaaagccaacgggataaaggcgttgccttaccatgcgggaatggattcgcaagtacgttccgccaatcaggatgccttcctgatggaacaggcggatgtgatcgtggctacgatcgctttcggtatgggtatcgacaagccggatgtccgttatgtgattcattacgatatcccgaagagcctagaaggttattaccaggaaaccggtcgtgccggtagggatggcggagaaggccaatgtatcgctttctatgcttataaggacttgcaaaaattggagaaattcatgcaaggaaagcccgtggccgaacaggaaatcggcaaacagttgcttttagagactgcagcctatgccgagacttccgtctgccggagaaaagtgctattgcattatttcggtgaggaatacctggaagataattgtggtaattgtgataattgtttgaacccaaagaagcaggtggaagcgaaggaattgttaagcgcggtactggaggttatcagtacgttgaaagaaaagtttaaggcagattatatcgtaaatattttggtaggtaacgaaacctccgaaatccaaaattacaagcacaatgaattagaggtcttcggttccggacaggacgaggatgataaaacttggaacgccgttattcgtcaggctttaatcgctggctatttagcgaaggatattgagaattatggtttgctgaaaatcacggaaaaaggtaaggagttcatgaagaagccggtatcgttcaagattaccgaggacaatgaattcgaggaagaggaagaggaagttccggttcgtgggggcgcctcttgtgcggtagacccggttctttattccatgatgaaggatttgcgtaagaaattatccaagcggttggaagttccgcctttcgtgattttccaagatccctctttggaggctatggctactacttatccgatcacgttggacgagttgcagaatatcccgggagtgggcgctggtaaggcgaaacgttatggcaaggagttcattgagttgatcaagaaacatgtagaggagaacgagattgagcgtccggaggatttgcgcgtacgtacggtcgctaataagtccaagttgaaggtctcaatcattcagcggatcgaccgtaaggtggcgctggacgagatcgcgttgactaacggacttgagttcaccgagcttttggatgagatcgaggcgatcgtatattccggtacacgtatcaatatcgattatttcttgaatgatgtgatggatgaggatcatatcgaggatatttacgagtatttcaaggattcggagaccgacggtctggaagacgccattgaggaattaggcggtgactatacggaagaggagattcgcttggtccgtatcaagttcttgtctgaaatggcaaactaatgggagggtggcccggttccactctaaagaaaaaacaaataaagaagcttattgttccttccgaaagagatttatttttccttcggaaggaattttgttttcgttcggatgaaagtttattttcttccgaatcgaatttttaatttctcccgtatcgatttattgcgtgaaaagtcgtatatttgcgcgcaataatttttaaagcataagttctatgtcatttattgcagacagggtagttatggatgggttaacgtttgacgatgtattgttaatcccagcttattcggaagttcttcctcgtaatgtcgatctcacgacaaagttttcacgtaatatcacattgaatataccgatggtgtcggccgctatggatacggttaccgaggccaagttggctatcgctatcgcccgtgagggaggtattggtgtgattcataaaaacatgacgatcgccgagcaggcaaagcaggtccagaccgttaaacgtgcggagaatggaatgatctatgatccggtgactatcacgaagggcaagcgtgtggcggatgccttggcaatgatggctgaatataagattggcggtattcccgtggtggatgaaggcgggtatttggtaggtatcgtgacaaaccgtgacttgcgtttcgagaaggacatgaaccgttctatcgacgaggtgatgacgaaagagaatttggtcgtaaccggacaatctacggatatggaggccgccgctcagatccttcaggaacataagatcgagaagttaccggtggtcgatagccataataagttgatcggcttgattacctataaagatataacgaaagcgaaagataaaccgaaggcttgcaaggattcgaaaggtcgtttgcgtgtagctgccggtgtaggcgttacgttcaataccttcgagcgtgtagccgctttggtggatgccggggtggatgctttggtgatcgacacggcacatggtcactcaaaaggtgtggtggatgtcttgaaacagattaaggcgcaatatccgcatattgattgtgtggtcggtaatatcgctacgggcgaggccgctaaatatttagtggaagccggggcggacgccgtgaaggtaggtatcggtccgggttcgatttgtacgactcgtgtgatcgctggtgtgggtgttccccagttgtcggctatttacgatgtggcgaaggcgttggaaggaactggtgtgcctttgatcgctgacggtggcttgcgttactccggtgatatcgtgaaggcgatcgccgctggtggatcttccgtgatgatgggatctctgttggcgggtgtagaggagtcgccgggcgatacgattatcttcaatggccgtaagtttaagtcttaccgtggaatggggtcgttggaagctatgcaaaaggggtccaaggatcggtatttccaagatgtggaggacgacgtgaagaagctggttccggagggaatcgctgcccgtgttccgtttaagggttctttgtatgaggtcatttaccaaatggtaggtggtttacgtgcgggaatgggttattgcggggctcataatatcgaggagttgcataaagctcgttttactcgaatcaccaacgcaggtgtgcaagagagccatccgcatgacgtagcgatcacgcaagaggctccgaattatagccgcggtgaatagtaatacaagttttacgttttataaaaaacactaatttaatgggatagcatacttttcttgtcggctctccgttagattagtgttatttttgtaatgtatattcgtgctatggtaaaagaatttttgatgaaaaagttacttatttcattaggggtattcgcttgtgtgacagttaacgctcaaaccgcatccgattcggtcgttatgacggtcgctggaaaacaagtgcctttatctgaatttatttttatcgcggagaagaatggagaggtggatttatcgaatacaaagtccgtcaaaaactatgtcgagctatttaaaaattttaagctaaaagtagcggaggcggaatctttagggatcgaccagacatcctcattcaaaagtgagctggatggataccgggctcagttgatcgatagctatatgtcggataaggagggtgagaaagcggctgcccgtgcggtatatgaccgtggggatcactcggtagagttgacccacatcttattccgtttgccggagaagacggtctccaaagatacggtagctgtatatcaagaagccatgcgagtatacgaacgtctccagaaaggagaggatatggaaacagtcggaaaagctttggccgagaaggataaggagcatgtcgcttgcgaatatgtacgttgcttgctcccgatgcaatccctaaaagtgtttgaggatgccgcctattccttgccgattggcgtggtgtctgaaccggttcgcacgaaattaggatttcatttgataaaagtccatagtcgtaaacccaatccggggcgggtacatgtcgctcatatcttgatcgccttcccgaaagattccgctattcaggactcatcggcttttctggcaaaagcgcaagctatctataagcaagtacaagagggagctgattttggcgagttagcgaaagaatattctggggatgctgcttccgctaagaaagagggagtattaccttggtttggggtaggcgagatggtccagccttttgagcaagccgcttttgcgttgagcaagccgggtgatttatccgaggtggtggaaactcgttttggttaccatatcattaagttgatcgataagaagggacgcccttcgtttgaggaagaggaaaaagctttgtcgagacgtatggggcagggtgaacgtaacttcgagttatataaagctttcgacgatcgtatgaaaaaagaatacggatacgttttctatccggaagcctatgcggagctgcaagcgttatgtaatgattgtttccccacggacgaggcgttttatgagaaagcgaaggatatgaacaagacgcttatgcaattggatggaaaggatttcccgcaagcggagttcgcttattatatccaacgttgtccgttctcgacaaaaacgtatgcgggtgattttatgcaagagatctatgatttgtttatccgcgatatcgtaacgaccgccgagcgtaagaatctggagacaaaacatccggagatccctcatttgatgcaggagtaccgggatgggattctgttgtttgaggtcagcaaccgggagatctggagcaaaccctccgcccagcagaaggtgttggaagcgaagtggattgcggatttgaataaaaaatatccggtgactgtcaactggaaattattgaagaaactaaagaaataaaataaagatagatatgaggatagtcttcatgttcctaacgttcgttgtgttgttgggtgcctgtaaaggttctcagccagctgatactacggatgtcttggttagcgtgaaaggacgtaccctaaatcgttcggaggtgaataagctaataccccgggggatttcctccgcagatagtctgttgctggccgagggctttaccaagaaatgggtaaaggatgtattggtgtacgatgtggctttgcgtaacttaggggatgagaaagaggaggtcgataaattggtagaggagtacaggcgttccttggttcgttaccgttatcaggaacgattggtggaggagaagctgaaaactgatatccgggaaagtgataaattaaactattacgaggaaaaccagaaaaagtttatcttggataaaggcttgatcaagggattattcttgaaaatcccggttgatgccccgggacttaccgacgtcaaaaagtggtacaaatccacagatgtggcctctttagaaaaaattgagaagtatagtgtgcaaaatgccacgatttatgagtacttttacgacaaatgggttgatttcgatgaggtaatggataatataccgatccatgtgtcgaatccgaatgcgtttctgaaggcgaataagtatgttgaggtggcggatagcagttattgttatctgttgaatatcaaggaatatttaccttccggcagtgtggagccatatgattatgccagtccgcacgtcacggaaatgctggtcaaccaacgaaaagttgaattcttgaaaaaatttgaagacgagttatataacgatgcgatccggagcggtgacgtggaattccattccgagccgtgatctctaattttataaatgggtagacatgatgaaaaagattttaagtgtattctttcttgcctgttgttcttgccttgtaatggcgcaagacaatgtgatcgatgaaattgtgtgggtggtaggagatgacgctattttacgttcggatatcgagacgcaacgtttgtataatcaaaacgagggggtccgtttggatggcgacccgtattgcgtgatcccggagcagatggcgatacagaaactatatctgaatcaagctaagatcgatagtattaccgtgaacgagaaccaagtgatccagagcgtggatcaatggatgaacatggctgtgaaccaaatcgggtctcgcgagaaattggaggaatatttcggtaagaaattttcccagatcaaggatgagcgtaaggagatggtgcgggagcagcaggtagtgcaacagatgcagcatcaattgatcggcgagatcaagctgacaccttccgaggtgcgtaaatatttcagccagttgtctcaggatagcctgccgaacatccctacgacagtagaggtgcaaatcgttaccttggaaccgaagattccgtttgaggaaacagacgctatcaaggcccgcttacgtgatttcacggagcaggttaattccggtaagatggaattctctacgttggctcgtttgtactcggaagatccgggttcggcgtctcgaggtggtgagctgggtttcatgagcaagacacagctgttgccggagtttgcgaacgtcgcgttcaacttgaaagacccgaaacgtgtctcccagatcgtacagacggagtatggttaccatatcatccaattgatcgagaagcgtggagaccgtatcaactgccgccatatcttattgaaaccgaaggtttccgataaggagttggcggatgctaccactcgtctggattcattgtacaatgatttgcaggcgaataagttcacgtttgaggaagccgctacattcgtctcttatgacaaggatacacgtaataataagggtttgatggtaaaccaagattacgagagcagcaatatgggaacccctaagttcgagatgcaagaacttccgcaggaaatcggtaaggtggtatatggcatgaaagtcggagagatctccaagccttttaccatgttgacgaacaagcagaaagaggtagtagctattgttaagctgaaagctcggacggaaggacataaggcgaatttggccgatgacttccaagctttgaaagcgatcgtagaggctaagaaacgtgaggaattattgaacgactggatcacgaagaaacaaaaatcaacctacgtgcgtattagtgacggttggaggaattgtgatttcaaatatccgggttggattaaggaatgagactaattaacaggttatttctagcgctcttatcgtgtgctttatcggttggcgtatttgcgcaaacgcaagatagcacggtggtagccgccaaagatagtgtcgctcccaagaagacgaaggtctttttggagcatgcgaatacgctttcgttcgataaggagaggaacgccgaggctcaagtactgaatggtgatgtttgttttcgccatgatagttcgtatatgtattgcgatagcgcatatttctttgagcagaccaattccttggaagcgtttagtaatgtccggatggaacaaggggataccttgttcgtgtatggaaattacctgttttacgatggaaatacccagatcgcttatttgcgggagaatgtccgcatggagaatgggcaggttaccttgtttacggatagcttgaactatgagcgaatcccggatatcggatattatttcgacggaggtctgattgtcgattctttgaatcagctctcttctttttacgggcaatattcgcctagtacgaaattggctatcttcaatgatagcgtccgtctggagaatgagcaattcacgttgtattccgataccttgcattataatacggactcgaagatcgccacgatcctcggaccatccataatcgtctcggatagcggcacgatctattcttccagaggttggtacgataccgtgaataatacctctttgctattggatcgttctcaggtggtttccggcgaccgtatcttgacgggcgactctatcgcctacaaccgggaactgggttttggggaagcgttcggtaatatgagtctgcaagacacggcgcagcatgtcatgctggaaggccaatatggcttttacaatgagaagaccgagtatgctttcgctacggatagcgcccgtttcttggaattcagccaaggggatacattgtttctgcatggtgataccttgaagatgactacggtggactccctttaccgggaagtaaaagcttattacggcgtccgtttctatcggacggatatgcaaggtgtttgcgattcgatgcagtttaatacaagagactctatattatatatgtatacggaccctatcgtttggaatgaacagtatcagatctatggggatacgatcttgatatttatgaatgatagctcgatcgatttcgctcacgtgaagcaattcgctttcgcgatacagcaaatcgattctaccgcattcaatcaattaaagggaaatgacttgaaggcttatttcgagggacaggtcgtgaatcagatcgatgtgtcgggtaacgccgaatcgattttcttcccattggagaaggacggttcgatggtcggcatgaacgagaccaagagcggtttccttacgatctggctaaaagacaataagttggataaactgaagatctggccgactccaacaggtacgatgacccctattcctgatttgaagcccgaccagaaatacttgaaagacttttattggtttgattatatccgtcctaaagacaaggatgatatttatcaggtcgtgaaaagaaaagctcaagatgctccgaaaagaagcaataaattcgtacattagcgtcgtattcataattaataggtaaagctatggcacttttctcgttttataacatgcgcaagccgcgtcaatttgatcataagcctatttattgggacccccataaggaagccttggaggaacgtataagcaaggtcaaacgtgaaatgggtgtagaggagccgttggaggaatataagccgcatatcaagggaactttcattgaaggtacctcgcatctgaagaaaagcgtggggcgaggcgaggattcccgggctcgtaggtataagaatgtgaaactggcggtggccttggcggtcttggctgctttcttttggtatttgttctggtaatgagcgatatcattcatttacttccggaccatatcgccaatcaaatcgcggcgggagaggtgattcaacgtccggcctctgtcgttaaagagttggtcgagaatgcggtggacgctggcgcttccaatatccaagtgaacattaaggatgcgggtaagacattgatacaggtgatcgatgacgggaaaggtatgtccgagacggatgctcgcatggcttttgagcggcacgctacttctaagatttctacggccgaggatttattctctttgcatacgatgggtttccgaggtgaggcattggcctctatcgccgctgtcgcccatatagagttgcgtacccgggctagagggaccgagcttggcacttgtctatccatcgcgggttccaatttggagagtatcgagccggaggcttgtaacgagggaagtatcttctcggtaaagaatcttttctttaatgttcccgcccgccggaaattcttgaagtcgaatgagacggaattccggaatatcatcaatgagttcgagcgaatcgccttggtgaatccgcaggtgggtatgtctctttatcataatgacgcggagatattcaatctgcccgagtcggggttacgtcagcgcatcattaatatatatggtaagagtttaaaccagaagttgctctctctggatgcccaaagttccatggtgactatttccggtttcgtggggcgtccggactcggcgaagaagcgaggggcattgcagttcttttttgtgaatggtcgttatatgaagcatccttatttccataaggcgatcatgcaggcctatgagcaattgattcctgccggggatatgccgaattattttgtttatttcacgttggatccctcctcgatcgatgtcaatatccatccgacaaagacggagattaagtttgagaacgagcaaccgatctggcagatcttgatggccgctacccgggaggcgttggctaaatcgagcgctatccctacgattgatttcgacgtggaggatgcgatcgatattcctgtttacaacccggtcaagaaaagtgagcctagtacttataaggccccgaaagtgcaagtggattccagttataatccgtttgacactacttcctataaaaaaccggaattcgattggtctaaattatatcaagggtttgagaacgatcgagtggctgcccaactggagtccgagagtttcgaggatgccccgatcgaggaattgccagccgaggcttcgaacccggaaaacctgtttgcggaggtaagcaatccttgctatcaatataaagggcgatatatcgtgacatccttgaaatcgggtctggcgattattgaccagcatcgtgcgcatgtgcgtatcttgtttgaccaatacctgtcgaatatccgtcagcaacaaggtgtatcccaacaagtcttattcccggagatcgtagagtttaccgctgccgaggcggctgtactaccttccttattggaggatttgtgcttcgtcggctttgatctgagcaatctgggaaatgacaattacgcgatcaatggcctgcccgccggtatagagaaccttgatccggtaaatttggtaaaggatatcgtggaccgggcgatcgagaccggatgcgcagtgcatgagaagatctgcgaggccatcgccttgtctttagccaaagccgccgctatccgtcccggcaaatccttatccttggaagagatggatcatctgatcgcctccctgttctcttgttcggactcgaacctgaccccggatggaaagacgattatctccatgctgacagatgaggagctggagagaagatttaagtgctagggatgatttcgatgacataggtttcacggctgcatttacatttaggtttcccggacatgcggcccggaagcaggcgtggaacacatcttcctcgatcggacgtttatagaaagcctcattcgatcgcatgatcgcctcctcctttgcggaggtgaaccaatggcgctctcctttttgtaactcgtttttcagctgggcgtagatttgatcatgctcgataccttcgcaattaatcttgctttgcacctccacgcataggaaacggcggcttcccgtggggtcgcttaataggttcttctggttcgtagtgccaataaatgaggctaggcggggtagggggggaatgcttggcgtgtgccttgcgtacgttcattccggccatctgcatccaatttttcagtaaagccattttacggtcggacaaccggtcgaactcatcgaggttgatgagtccgaacaatccaagcttctgctccatttgcgtcgagccgctaaggtctacgctatccgtgtaatagcggactagcgaagaaggcatcagcgacttgcaaaaggtagacttctgacatccttgacgctcgctgactaaaatgggagccaagctatttgcgtgcattcggtccgaacccatccattgcgaggccaaggcgagcatccagcgatgaaacccctccacccataacggttctgaggagacccgtcgtgccagatcgcttacccggtctttcccgtcccattcgggtaaccactccatatattgccggaaaggatgatactcttttacttcttttgaatatacgaaacgattcacatcccgatccctgcaatcgatccccgtccgtcttgcctccatgcaaatgctatttaggtcacgttgcgtcaccggatagaagcgatccgtttccaattgtttgtatcgatattcagtctcctcgctcaacaagttgaagtggaattcgatccgttcttggaggaaagtctccagactcttttgaaggatagagttgctgttgctcgatcgtttcgctttaccttcgtttgggtgtggtacggtgatcgacccgtccggttttaagaagcgaagccataattggcctaaaaaatccaatacagttttcatgacgctatgttttagaggttgtttttactgtttcattttgcggatataagctgttaacttgcggttttccaaatgtttatattgtcatttgaaataaaagtaatctgtgcgaaatactagggaaaactattgtttaagtggtatggatgtagtacctttgttaagtgcttataatcttttcacctatgtgaaaagaacgtatcacaatcatgaaacgatcgtttcacataggtgaaaagatcatatcacccttgtgaaatgactaatagcatacgatgtttcgatgaataaccttttaatctcatactagatatatggcagcaaaatatgacttttacaagactccggtatcgaaggacagcacgaagcgtcctcgttttcacgcacgtatcgtatcatccggcacgatcgatacggatgatctggccaaacgtatccatggacggtgtaccgtcacgccggcagacgtagccgccgtgcttatctctttaagcgaggtgacagcggaatatttgcgtgaaggaaaacgtgtacatatcgatgggttggggtatttgcaagtcacgttgcaatgcccggccgtacaatccacgcacgagatacgtgcggagtccatccgtttcaagtccgtggctttccgtcccgaggtagagctgaaagatagcttgaagacgatgacgctggaacgagccaagtacaaatcccattcccgccaattggagcctgatcgtatcgaccaattgctcgcgagttattttgccgagcatgaatatatgacccgtgtcgccttccagcggctttgcggcctgacgagcagtacggccagccgccgcctgcatcaatttgtcgaggcgggtaaattgcgtgatatcggcacccgccaccagtcgctttacgtgccagtgaggtaaatagagatagtgaatgttaaatattaataaatatggctagggcctaccttgccaaacgggaacaaatatgtacctttgcaccgtttttagtgcggagtatgcgaaaaaaacaggcacaacttattgattgtccgaaaataatacgtaactttgcggctcgaaataggaaaagattagataaataataataacacattcaaagtttaaaaaaagaaagaaatgcctacaattcagcaattagttagaaaaggaagggaaactttggtggagaagggtaaatcacccgcattggacgcttgtcctcaaagacgtggcgtttgcgtacgtgtttacactacgactccgaagaaacctaactctgcaatgcgtaaagtagcgagagtacgtttgacaaatggtaaggaagttaactcctatattccgggagaaggacacaacttgcaagagcactctatcgtattggtacgtggtggtcgtgtaaaggaccttccgggtgtgcgttatcacatcgtacgtggtacgttggatacagcgggtgttaacggccgtacgcaaagacgttccaaatatggagctaagcgtccgaaaccgggtcaagcagcagctgccgcaaaaggtaagaagaagtaattaattacatgccttcaaactgagatttaaatttaagtattaaaacaggtttgagttatttggataggctataaggttgagtaaatggttcagcggaaccgttgaagacaaattaaaggcaaccaacgacaagaacaaatttttgaaaacaaaatgagaaaagcaaaaccaaagaaaagacagatccttccggatcctgttttcggtgatgtaaaggttacgagattcgttaaccatttgatgtatgatggcaagaaaaatactgccttcgaaattttctattccgctttggaaaccgttaagggcaaattgcctaacgaggaaaagtccgctctcgaaatttggaaagctgcgcttgataacattactcctcaagtcgaagttaagtcacgccgtgtaggtggtgctacattccaagtccctactgaaatccgcccggatcgtaaagagtcaatttctatgaagaaccttattatcttcgctcgtaaacgtggaggtaagactatggctgacaagttgtctgcagagattgtagatgctttcaataaccaaggtggcgcattcaaaagaaaagaagatatgcaccgtatggctgaggctaaccgtgcgttcgctcacttcagattttaatttttaaggcaataaaaagaatatggcaaacaacgataagcaattgatgttcactaggaacatcggtatcatggctcacattgacgctggtaagacaacgacttctgaacgtatcttgttttacacaggtttgacacacaagatcggtgagactcatgatggtactgctacaatggactggatggcgcaggagcaggagcgtggtatcacgattacttccgctgctacgactacattctggaactatttgggcaaccgttataaaatcaacttgattgacactccgggacacgttgacttcacggttgaggttgaacgttctcttcgtgtattggatggtgctgttgctacattctgtgccgtaggtggtgttgagccccagtctgagactgtatggcgtcaggctgataaatataatgtacctcgtatcggttacgttaacaagatggaccgctcgggtgctaactactatgaggtagtacgccaattgaaggacgtattaggagctaatccttgtccgatccagatccctatcggagctgaggagactttcaagggtgttgtcgacttgatcaagatgaaggctatcttctggcacgatgagactatgggtgccgagtatagcgtagaggagatcccggcagacttgcaagctgaggctgaggagtggcgcgacaagatgcttgaggctttggctgagtgcgacgacgctatcatggagaaatacttcgatgatccttctacgatcacggaagaggagatcatggttgctatccgcaagggtacgttggctatgcagatcaacccgatgacttgtggttcttctttcaagaacaaaggtgtacagactttattggatgcagtttgcgcgtttttgccttctcctgaagatactccggctatcgagggtacggatccttcagatcctgataaaataatcactcgtaaacctttgttcgaggagccattgacggcgttggcatttaagatcgctaccgacccgtatgtaggtcgtttgtgcttcttccgtgtatacgcaggttctatcaacgctggttcttatgtgttgaacactcgttccggaaagaaagagcgtatctcccgtttgttccagatgcactctaacaagcagaacccgatggaggtgattggttgtggtgatatcggagcaggtgttggtttcaaggatatccgtacaggtgatacgctttgcgacgaaaaccatccgatcacattggagtctatggaattcccggaaccggttatcggtatcgctgtagagcctaagactcagaaagacatggataagttgggtatgggcttggctaagttggccgaggaggatcctactttccgcgtacagacaaacgaggagacaggtcagaccgttattagcggtatgggtgagcttcacttggatatcatcatcgaccgtttgcgtcgtgagttcaaggttgaatgtaaccaaggccgtccgcaggttacttataaggaggctatcacgcagccggttgagcttcgcgaggtttacaaaaagcaatctggaggtcgtggtaagttcgctgatatcatcgttcgtatggagccggctgacgagagcttcgagggtactttgcaattcatcgatgaggtgaagggtggtaacattcctaaggaattcatcccgtccgtacagaaaggtttcgagaaggctatgaagaacggtgtgttggcaggttatccgcttgacaagctgaaagtgactttgatcgatggttctttccacccggtagactcagaccagttgtctttcgagatcgccgctatccaagcgttcaagaacgcttccgccaaggcaggtcctgtattgatggagccgatcatgcagatggaggttgttactccagaagagagcatgggtgacgttatcggtgacttgaacaagcgtcgtggacaagttgagggtatggagactagccgtacgggagcccgtatcgtgaaggctaaggttccattggctgagacattcggttatgtgacagctttgcgtacgattacttcaggtcgcgctacatcttcaatgcagttctcacactacgctcaagtatcctcttctatcgctaagcaagtattgacagaggtgcaaggtcgcgttgatttgatcaaataatatttagaaacatataataaatatgagccaaaagatcagaattaaattgaagtcttacgattattctctggtagacaagtctgccgagaagatcgtaaagacggtaaaggctacaggtgctatcgttagcggtcctatacctcttcctacgcacaaacgtatctttacagtgaaccgctctactttcgttaacaagaaatctcgtgagcagttcgaactctcttcttataagagattaatcgatatctatagctcaactgcgaagacagttgacgctttgatgaagctagaattacctagcggtgtagaagtagaaattaaagtgtaagtttttaacaattagtgaaatgccaggattattaggaaaaaaaatcggaatgacatccgttttcagtgccgagggaaaaaatcttccatgcactgttatcgaagtgggtccttgtgtggttacacagatcaagactttggagaaagatggctacgaagctgtacagttgggtttccaagagaagaaagagaagcacacgacacagcctgagatgggtcacttcaagaaagccggtgtagcacctcaaagacacttggccgagttcaagaatttcgaaactgagtacaagttgggtgacgtgatcactgtagatttcttggaagacgcaggtttcgtggatgtagtgggtacatcaaaaggtaaaggtttccaaggtgtagtaaaacgtcatggttttggtggtgtaggtcagactactcacggtcagcataaccgtgctcgtaagccgggttctatcggtgcttgttcttaccccgcaaaggtatttaagggcatgcgaatgggcggccagatgggtaacgaacgtgtaaccgttcagaatcttcaagtgatcaaggtaatgccggaacacaaccttttattggtaaagggatctgttccaggagcaaaaggttcaatcttattaattgaaaagtaatggaactgagcgtatttaatattaaaggtgaagataccggaagaaaggtaactttgaacgatgcgatcttcggcattgaacccaacgatcatgctatttacttggacgtaaagcagtatttggcaaatcaacgtcagggaacgcataagtctaaagagagaagcgaagtatctggtagtacacgtaagctgatccgtcagaaaggtggtggtggcgcacgtcgtggtgatatcaactctccggtgttggttggtggtggccgtgtattcggtccgaagcctcgtgattatgagttcaagctgaacaagaaagtaaaatctttggctcgtaagtcagcattgagctacaaggcaaagaacaatgcgattgttgtcgtagaggatttcacaatggaagctcctaagactaaagaatttataacaattgctaaaaacttgaaagtggctgataaaaagttacttatggttttaccggagaagaataatttagtatatttgtccgctcgaaatttagagaaggcaagtgtaataactgcttctgaactaaatacatacgctgtgttaaacgctgttaatttggttttaacggaaagttcagtcgctgttgttgaacaaaattttaaagcataaggagtagaataatgggaattattattaagcctatagtaactgagaaacaaacagcgatcacagagaaatttccgaatcgctatggttttcgtgtttctcctgatgccaacaaattggagattaagaaagctgtagaggatatgtacagtgttacagtagttgatgttaacaccatcaactactctggaaagcgtaaaagccgttatacaaaatcaggtatcatcaacggcaagcaagctgctttcaagaaagcgatcgtaacgttgaaagaaggagaaacaattgatttctttagtaatatctaaaaagagaaatgggaatacgtaaattaaagcccacgacaccggggcagagacacaaagttattggtgcatttgataaaatcactgcaagtacaccagagaagtctcttgtagtaggtaagaagagtacaggtggacgtaacaacactggtaagatgacaatgcgttatatcggtggcggtcacaaacaaaagtacagaattatcgatttcaagagaaacaaagatggcattcctgcgacagtaaagtctatcgagtatgatcctaaccgttcatctcgtatcgctttgttgtattatgcggacggagcaaagagctatatcatcgctccgaacggattggaagttggccaaacagtggtttcaggtagcgacgccgctcctgaggtaggtaatactttgcctatggcaaatattcccgttggtactattattcacaatattgagcttcgtcctggacagggtgccaaaatggtacgttccgcaggtgcattcgctcagctgacttcaaaggaaggcgcttatgcgattattaagatgccttctggtgaaactagaaagattcttgcggcttgtaaggctacaattggcgcagttggcaattcagaccatgctcttgaaaaatcaggtaaggccggtcgctctagatggttaggtcgtcgtcctcgcaaccgtggtgttgttatgaacccggttgatcacccaatgggtggtggtgaaggtcgttcttccggaggtcatcctagatcccgtaatggcttatatgctaagggcttgaagactagagctcctaagaagcattcttcaaagtatattattgaaagaagaaagaaataatctgattaattaagtaaactatgagtcgttcgctaaaaaaaggcccgtatattaatgtaaagcttgagaagaaagttctggcaatgaatgagtcaggaaagaaagccgtagttaagacatgggcaagagcttcaatgatttcgcctgatttcgtaggccatactattgcagttcataatggaaataaatttattcctgttttcgtaaccgagaatatggtaggccacaagttgggagagttctcaccgacacgtactttccgcggtcacgccggtaacaagaagaaataatatcggtagtaacaggaattcaggaatctgaaaataaaaagaatcgaataaaatgggtgctagaaaaagaatatcagctgaagcaagaaaagaagcccaaaagaccatgtatttcgcgaagttgaacaatgttcctacctctcctcgtaagatgcgtttggtagcagacatgattcgcggtatggaagtattccgtgcgcttggtgttttgaagttttctaacaaggaagctgcagcaagagtagaaaaattgcttcgttcagcaatcgcaaactgggaacagaaaaatgaacgtaaagcagaagcaggagagttatgcgtatcttcaatcagcgttgattgcgctactacgttgaagagaatgcgtccggctcctcaaggaagaggttacagaattcgtaaacgctcgaaccacgtaactctgtttgttgatacacttagtaaaaacgatagtcaaaattaatttgtagatgggacaaaaggttaatccgattagtaatcgtttaggaattatccgtggttgggattccaattggtatggcggtaagaattacggggatactttgctggaagatagcaaaatccgtaaatatttgaatgcccgtcttgcaaaagctagtgtatctcgtatcgttattgaacgtacgcttaagttgatcacgatcactgtttgtacgtcacgtccgggtatcatcatcggtaaaggtggtcaggaagttgataagttgaaggaagagttgaagaagatcactgataaagaagtgcagatcaacatcttcgaggtgaagagacctgaattggacgctgttatcgtagcaaacaacatcgcacgtcagcttgaaggtaaaatcgcatatcgtcgtgcggtaaagatggctatcgcctctaccatgagaatgggcgccgaaggtataaagattcaaatctctggtcgtttgaatggcgctgaaatggctcgttcggaaatgtataaggaaggaagaactccgttgcacactcttagagcagatatcgactatgctttggctgaggccttgacaaaagttggtttgctgggtgttaaggtttggatctgccgtggtgaggtttatggcaagcgcgatcttgctccttctttcactgctgccaaggagacaggccgtagaaacgacaatgccggtggcaacagagacaagaacttcaagagaaaaagagctaatcgttaaacgttagaatttaagtagagatgttacaaccaaagaaaaccaagttcagaagacagcagaaaggtcgcatgaagggcgaagctcaacgtggcaaccagctggccttcggttcttttggaataaagtcattagagaataaatggattaccggtcgtcagatcgaggctgcccgtatcgccgttacacgttatatgcaacgtcaggggcaggtttgggttcgtatcttcccggataagccaatcacgaagaagcctgcagaggttcgtatgggtaaaggtaaaggtaatcctgagggatttgttgcgcctgttactccgggtcgtctgattttcgagatcgaaggtgttccctttgatatcgctaaggaagcgttgcgccttgccgcacaaaaacttccggttacaaccaagtttgttgtgagacgtgattatgacatgcaaaatcaaaatgcgtaattgttatgaagattgcagaaattagagaactaagcacgaaagagttgctagagagagtagatgcagaggttgcggcctatgatcagaagaagattaaccatagcatctcgcctatggataatccttctcagattaaacagcaacgcagattgattgcgcgcatgaaaacagaattgcgccagagagaacttaacaacaaataattgagcctgatggaaactagaaatttaagaaaagaaagaacgggcgtggtaacgagcaacaagatggataaaagcatcacggttgccattaaatggaaggaaaaacaccccatttatggaaagttcgttaataagacgaagaaatatcatgctcacgacgaaaataacgaatgcaacattggcgataccgtaaagattatggagactcgtcctttgagcaagactaaaagatggagattagttcaaataatcgaaagggctaagtaagatgatacaacaagaatcaagactagtagtagcagataacagtggagctaaggaagctttgtgtatccgtgttttgggcggaacgagaaagcgttatgccactgtaggtgatgtgatcgtagtagcaatcaaaagcgtaatcccagctagcgacgttaagaagggtgctgtttctaaggctatcatcgttcgtactaagaaagagatccgccgtccggatggttcttatatccgtttcgatgataacgcttgcgtattattgaatgccggtggcgatatccgtggtagccgtatcttcggtccggttgccagagagcttcgtgcaacaaacatgaaaattgtatcacttgcacctgaagtgctttaatctcgtaaaatttaaagtaatgagtaaattacatatcaaaaaaggcgatatagtatttgttaatgccggcgaggacaaaggtaagacaggtcgtgttttacaggtacttgtaaaagataatcgtgcgattgtcgaaggtattaatgtggtatcaaagcataccaagcctaatgcgaagaatcctcaaggaggaatcgaaaagaaggaagctcctattcatctttctaaccttaacgtggttgacccgaaatctggtaaagctacacgtatcggccgtaagttgaatgagaagggtgctttagtgcgttattctaaaaaatcaggggaggaaattaagtaatgagcaatactgccagtcttaagaaagaataccaagacagaattgttcctgccttaacgaaggagttcggttacaaatccgtgatgcaggtacctgttttgaagaaaatcgtgattaatcagggattaggtatggctacggctgacaagaagatcatcgatatcgctatcagcgagttgtctacgatcaccggtcaaaaagctgtcgctaccgtatctaaaaaggatatctctaactttaagttgcgtaagaagatgccgatcggtgtgatggtgacattacgtcgtgagcagatgtacgagttcttggagagacttgttcgtgtcgctcttcctcgtatccgcgacttcaagggaattgagagtaagttagacggaagaggcaattatacactcggtattcaggaacaaatcatttttcctgaaataaatatcgataatattaccaaaatattgggaatgaatattacctttgtgacctctgcgaaaacagacgaagaaggttatgctcttttgagagaatttggattgccttttaaaaacggaaaaaaagactaagtagttatggctaaggaatcaatgaaggcccgtgaggttaaaagagcaaagcttgttgctaagtatgccgctaaaagagctcagcttaaggcagaaggtaactatgaggctttgcaggctttacctaaaaatgcttctcctgtacgtttgcacaaccgttgcaagattacaggacgtccgaaagggtatgtacgccagttcggtatttctcgtatccaattgcgtgaaatggcatctaatggtttaatcccgggtgtaaagaaagcaagttggtaagagtttttttagtttaaatattgtccgggtggccggatcaatttaattaattatttatatgacagatcctattgcagattatttgacaagattgcgtaacgcaatcaaagcgaagcacagagttgttgaggtgccggcgtcaaatttaaagaaagagatcactaagatccttttcgacaagggctacattcttaattttaagtttgtagaggatggtcctcaaggtacgatcaagatcgccttgaagtatgacctagtaaacaaagttaatgcgattaagaaacttgagagagtttctacgcccggtttgcgtaagtacactggttacaaagaaatgccgagagtattgaatggtttaggtattgctgttctttctacttctaaaggtgtgatgactgacaaagaggcccgcgatctgaagatcggtggcgaggtattatgttacgtttattaattaggagggaagaagaatgtcaagaataggaaaattaccaattcatgtaccggctggtgttacagttacaattaaggataatgtagtaacagttaaaggccctaaaggtgaacttgtacaggaagtgaatcctgatattaacgttactttggaagacggagttatccatttaacaagacctactgatgataagaatcatcgtgcgttacacggtttgtatcgttctttgatcaacaacatggttgttggctgctcagagggatataagaaggagcttgagttagtaggtgttggttaccgtgtttcaaatacaggtcagttattggatctttctttaggttatactcacaatatctatttgcagttgccgaaggaagtgaaagttgagacgaagtctgagagaaataagaaccctcttattatccttgaatcggctgacaaacaattattaggtcagatttgtgcgaagatccgttcattcagaatgcctgaaccgtataaaggtaagggtattaagttcgtgggtgaagagattcgcagaaagtctggtaagtcagcaggtaagtaatctacgtaaactgaaattatcatgacaacgaagctagaaagaagattaaaaataaaagcaggcgtacgcggcaaaatctcaggaactactgagcgtccgcgcctgactgtgtttagaagcaacaagcaaatctacgcacaggtgatagatgatactacaggcaagactttagccgctgcttcatctttgaaattagatgttaaggctccgaaaaaggagatcgctgctaaggttggtgaattaatcgctaaaggcgctcaggaagctggcgttcagacagtggttttcgaccgtaatggttacctgtatcacgggagaattaaagaattagcagatgctgcacgtaacggcggccttaaattttaatgaagatggcaaataatagagttaaatcgaccaacgacttagagttgaaggacagactggttgcaatcaaccgtgtaactaaggttacaaaaggtggacgtacattcagttttgctgctatcgttgtagtaggaaacgaggatggtatcgttggctggggattaggtaaagccggtgaggtaacgacagctatcgctaaaggtgtagaagctgctaagaagaacttgatcaaggttccggtacacaaaggtacgatccctcacgaacaattagctaaattcggtggtgctcaagtgctgattagaccggcatctcacggtaccggtgttaaggctggtggtgctatgcgtgccgtattggagagcgtaggtattacagacgttttggcaaaatctaaaggttcttccaaccctcataacttggtgaaagctactatcgctgcgctaggtgagttgagaagcccgttcgatgttgctcagaacagaggtgttgctgttgaaaaagtatttagaggttaattagggggggataagtttatggcgactattaaagtaaagcaagttaaaagtagaattaaatgcccgaaagaccaaaagagaacgcttgacgcactagggctgagaaagatgaaccagattgtagagcatgaagctaatccggcgatcttaggtatggttgagaaagtgaaacatttggtttctgtagaaaagtaataattggttgaaaaaataaattatacgatatgaatttatcaaatttaaaaccggctgaaggatctaccaagaccagaaaaagaatcggacgtggtccgggttcaggattaggcggaacttcaacaagaggtcataaaggtgccaagtctagatctggctacaagaacaagattggtttcgaaggtggtcagatgcctattcaaagacgtttgcctaaattcggtttcaagaatattaaccgtgtagaatataaagctattaatatcgatactttgcaacaaatggcagaggctaagcaattgactaagattggtattaatgaattgatggaggctggtttcatctcttcttctcaagtggttaaaattcttggtaacggtagcttgaccgctaagttagaggttgaggctcacgctttctctaagagcgcagaggcagctatccaagccgcaggtggaacagtcgttaaactctaagtcatgagagctgttgaaacaatcaagaatatctggaagattgaggatctgagaaatcggatcctcaccactcttttattggtggctatataccgttttggtacgtatgtagtgcttccgggtatcgatcccaaagcgttaaccgctttacaggagcagacaagaggcggattgcttgcactgttggatatgttctcaggtggagccttttctaacgcatctatttttgcgttgggaatcatgccatatatctccgcttcaattgttatgcagttgttagccatcgcagttccttctttccaaaaattgcagagagagggtgagagtggccgtagaaaaatcaatcagtggactcgttacttgacgatagcgatcttgttattccaaggtcctacttacttggtgaatttaagcgttcagcttaaggctgccggcgctgctttaccgggtggtatttggttcacgatctcatctacgatcatcttggctgcgggaagtatgtttatcttatggctaggtgaaagaattacagataaaggtgttggaaatggtatttcatttatcattttagttggtattatagcccgtctgccgcactctttgttccaagaattcgtttctagaacaagtgagaaaaccggtggtctggttatgttcttatttgagatgttgttccttttgcttgttatcgctggtgcgatcttattggtacaaggtactcgtaaggtccccgtgcaatatgcgaaaagaattatcggtaataaacaatatggtggcgcgcgtcagtatatccctctgaaggtgaatgccgctaacgtaatgcctatcatcttcgctcaggcgatcatgtttattcctatctcaattgtaggtttctctagtacgggagagcagagcggtttttgggctgctttcatggataatacgggattttggtacaacttcgtgtttgcggtgttgattatcctgtttacgtatttctatacggctattacgatcaatccgacccagatgtcagatgatttgaagagaaacaatggttttattccgggtgtgaaaccgggtaagaataccaaagactatctggataccattatggaccgtattactttgccgggtgcttttttccttgcgttggttgctatcatgcccgctttcgctagaattgccggtgtaagtatggagttctcccaattctttggtggtacatctttgttgattttggttggtgtggtgttggatacattgcagcaagttgaaagtcatttgctaatgcgtcattatgacggtttgttgaagtcaggaagaattaaaggccgtacaggctctgttgccgcttattaatagaatgatctatttaaagacagatgaagagattgagttgatgcgtgaggctaatcaactggtaggtaagacacttggcgaggtagctaagcatattgtccccggagtctccacacttcaacttgataagattgcggaagagttcattagagataatggtgctgttccggcttttttgggatatggtggtttccctaattcaatatgtgcctcagtgaatgatcaggtggtgcatggtattccttcttctaagatgatcttgaaagagggtgacgtgatctctgtggattgtgggacgatattgaatggttttgtcggtgactccgcttacactttctgtgtaggtgaggttgcgccggaagtgaagaaattgttgaaagcgacgaaggattcactttatttaggtatccaatgtgctgttgaaggtcaccgtttgggtgatatcagtaatgcgattcagacttattgcgagtctcaaggttactctgtcgtaagagagctggtgggacatggtataggtcggaaaatgcatgaggaaccggaagtgcctaattatggcagacgtggatgcggaccgttattgcgtaacggaatgtgtatctgcatcgagccgatgatcaacatgggaagcaagaacgttgcatttgagaaagacggatggacggttcgcacaaaggacagaaagccttctgctcatttcgagcattgtatcgctatacgtccggatggtccccagatcttatcttcatttaagtttttagaggaagttctaggagaaaacgcaatttaattggatttatatggctaaacaatcagcaatagagaaagatggagtaattgtagaagcattgtcaaacgcgatgtttcgtgtagaattggagaacggacatgaaattaccgctcatatctcaggaaagatgcgtatgcattacattaagatccttccgggggataaggtaagagtagaaatgtctccgtatgatctatcgaaaggtagaattgcttttagatacaaataaaattaaacacgatatgaaagtaagagcatctttaaagaagcgtacacctgagtgcaagatagtaagaagaaagggtcgcttatacgtaattaacaagaaaaatcctaagtataaacaacgtcaaggataatttattatttttgcaaaataatctaagtaagtaatatggctataagaatagttggtgtagacttgccacaaaataaaagaggagaaatcgctttgacttatatctatggtattggtcgtagcgctgcaaaatccgtattagataaggctggggttgatcgtgatatcaaagttaaggattggacagacgatcaagccgcaaaagttcgtgaagtcattggcgctgagtacaaggttgaaggtgaccttcgttcagaagttcagttgaacatcaagcgtctgatggatattggttgctacagaggtgttcgtcaccgtgttggtctgcctttgagaggccaaagcacaaagaacaacgctcgtactcgtaagggtaagaagaaaactgttgcaaataagaaaaaagctactaaataataagagttaatatggcaaagaaaacagtcgcagcaaagaagagaaacgtaaaagttgacgcttacggtcaagctcatattcattcttcttttaacaacattattgtgtctttagcgaatagcgaaggacaagtaatcagctggtcttccgctggtaagatgggattcagaagctctaagaagaatactccttatgcagctcagatggcagcacaggattgcgctaaagtagcttatgatcttggtttaagaaaggtgaaagtattcgttaagggtccgggtaacggtcgtgagtccgctatcagaacgatccatggcgcaggtatcgaggtaacagaaatcgttgatgttacaccgcttcctcataacgggtgtcgtcctccgaaaaagagaagagtataattaattatagtttcttaaacattgaatccggaattgtgaatagattgcatattgaccttatcctctctgtaatcgcggctgcacggttccagattcaaacagaacatttaaaaaaataaaaaaatggcaagatatactggaccaagaacaagaattgcccgtaagtttggtgaggcaatattcggtgcggataaagttctttctaagaagaactatcctcctggacaacatggtaactccagaaaaagaaagacttctgaatacggtatccagcttcgtgagaagcaaaaagcaaaatacacttatggcgtattggagaagcaatttagaaacttattcgaaaaagcttcacgctctaaaggtattaccggtgaggtgcttcttcaattgttagaaggccgtcttgacaatgtggtttatcgtttgggtatagccccgacaagagccgcagctcgtcagttggtttctcatcgtcacattacagtagacggaagtgttgtaaacattccttcttactctgtaaaacccggtcaggttattggtgttagagaaaaatctaaatccatggaggttattgccgacgcattgtcaggtttcaatcacagcaaatatccttggattgagtgggatcagtcctcaatgagcggaaaattactgcatctgccggaaagagctgacattcctgaaaacattaaagagcagttgatcgtagaattgtattctaaataataattgatttccatggcgatattagcatttcaaaaacccgataaagtattaatgttggaagcggacaatttcttcggaaagtttgaatttcgtccgttggaacccggctatggtattacaataggtaatgctttacgtcgtattctcctgtcgtcacttgaaggttttgctattacatccattaagatcgacggggttgaccatgaatttggtacaatcccgggtgttatcgaggatgtgacaaacattatcttgaatctgaagcaagttcgtttcaagcatatcgtagacgacatcgagaatgaaaaagtgagtattactgtttcgggttcggaagtgttcaaagccggtgatattggtaagcaactgactggattcgagatattgaatcctgatttggttatttgccgcttggatccgaccgcaagtttccagattgaattgactattaataaaggtcgcggttatgtacccgcagatgagaacagagacccgaacgcagatatacatgtgatcgctatcgactctatcttcactccgatacgtaacgtaaaatattcaatcgagaacttccgtgttgaacagaagacggactacgagaagttggttcttgaaatagccacagatggttctattcatccgaaggaagcgttgaaggaagcagcgaagattctgattcatcatttcatgttgttctcagatgaaaagattgcgatcgagacagcggatactgaaggcaatgaagagttcgatgaagaagtacttcatatgcgtcagttgcttaagagcaagctggctgatatggacctttccgttcgtgcattgaattgcttaaaggccgcagatgttgaaacactaggtgagttggttaagttcaataagaatgatttgttgaaattccgtaacttcggtaaaaagtcgctcactgaacttgatgaactgcttgagagcttgaacctttcattcggtatggatatcacaaaatataaattagataaagagtaagtaaacgatgagacataataagaaattcaatcatttaggtcgtacaaatactcaccgtgacgcaatgctttcgaatatggcttgttctttgatcaagcataagagaatctttactacgacagcaaaggcaaaagcgctacgtaagtatgtagaaccacttatcacgaagtctaaggaggatacaactcactctagacgtgtggtatttagcaatttgcaagacaaatttgctgtaacagagttgttcaaggaaattgctcagaagatcggtgatcgtccgggtggttataccagaattatcaagactggtaaccgtttaggtgacaacgcagctatgtgctttattgagttagtagactataacgaaaatatgttgaaggatacagccgctaagaaagctcctaaaacaagacgttctcgtaaaaaagcaacagcatcggttgcagaagctcctacagctgaagcagctagcgaggaaaaagcagctgaataagcaagttttttataatcatataagaaaagcgattcgtacacacggatcgctttttttgttgaggtatagtgcaaatatagcagtgtaaagaaatatgaagtttataattgtttttattgtatgctttgaagagcctcctgcgctaccttattagaaggatcgatctctaagaccttattccagtatatttttgaattgtccagatctttttgaggtaatagaaatagcccagataacgatagtattcggctagtttcactgcttttgagagattctctaaagatggttcatattgctgagtcgcatttaataagcggtcttggtataaataatcttgccaaatgaactttccattaggcgtgttgaaaaatccagaggtttgttgtatgccattatcataatctttcgtctcgaaagcgttgtacaaattcagacgttgcggtaagaaattatccggttcagtggaaagcccttttgcgatgacttctccatcctcttgatcaaaagagtatccggtatggtgattatcatcaatatgatcttcacaagaagagcacaggcaagctttatattccggagggacagatgcggtatccgcataaatgaactcccctttgccaaacagcaggaataaatctagaagagtcaatagtggtaagtacctttttcatcttagtatgagtatattctttcataaacaacaaaagctttttttgaaaggtttaggcaaatagtaaaaatcatctattaaaagattgaaaaactcgataggcttccgcaaacattccttgcttggctattgttatatttgtgaaaaagaaaagtaagacatcattgaacaactaataaaacaaatatagtaatatggaaattgtaaaagtagtaggtagagagatacttgattcacgtggtaacccgacagtagaagtagacgtacatttggcttccggcgcattcggtcgtgcggctgtaccttctggcgcctctaccggtgagaacgaggctatcgagttacgcgatggcgataagaatcgctacggtggcaaaggcgttctccgtgccgtggataatgtaaataaggtaatcgctcccgccattttaggaatgagcgccttgaatcaaagagagatagaccataagttgctggatttggatggtacaaagacaaaatcaaatctaggagctaacgctatgttaggtgtatcgcttgccgtagcgaaggcagcggctaattatctggatctgcctttatatcgttatatcggtggaacaaatacctacgtgttgccggttcctatgatgaacattatcaatggaggttctcactccgacgctccgatcgcttttcaggaattcatgattcgtccggtaggtgcgaagagtttccgtgaggggcttcgtatgggcgcagaggttttccatgcgttgaagaaagtattgcacgatcgtggcttgagcacggctgtaggtgatgagggcggtttcgctccggcattggatggtacggaagatgccttgaattctattatggccgctatcaaagccgctggatatgagccgggcaaggatgtgacgatagccatggattgcgctgcttccgagttttatcacgatggtgtttatgattatacggaattcgagggtgagaaaggcgctaagcgtaacgcccagcaacaagtcgcttatctgagtgagttggtgaacaaatacccgattgattctatcgaggatggtatggacgagaatgactgggccggttggcaaatgctaacctccacgctaggcggaaaatgccagttggtaggtgatgacctattcgttacaaacgtagagttcttgaagaaaggtatcgagaagggttgcgcgaactccatcttgatcaaggtaaaccagatcggtacattgagcgagacattagacgctatcgagatggcccaccgtaatggctatacatccgtgacttcccaccgttccggtgagacagaggatgctacgatcgccgatatcgccgtagctaccaacagcggacaaatcaagaccggctccttaagccgttccgatcgtatggcgaaatacaaccagttgcttcgtatcgaggaggaattgggttccttggctgtttatggttataagacttataagaagtaattttcattatttgcttgagaaatgggggagttcacctatcaaggtggactccctttttctttttagtggaaaaaacgaagcaaacctactaatcaatagccagcctgctccaaacatttaatgattataaatctattgccctaaataagagagtgaatgttgtatctcttctctagagaccgagaagttcctgttcccggccaatttatttaatacgagtgtgcctatgttttctgcgctttccttatccgggaacgcaattaccgtatcaatagagggaatggtgggttggtaaatcaacacctttccgttcatcctaatctggtacccccagccatcccccgattgaaatgtttgcaactccagttgccgcccgggagaagaccccatttcttcaccccggaaaaaagataaataaaacagtaataccggcagtaccactaggcccggtacgaaccaagcccgtcctttcttagtattcatcatcgtcatattcattcgggtgaaattcccaaatatcatcaaattgagtggtaccacttttgccggatactacgaatcctttctcgccagaggagaaagatgctgtcgccgtacgggcagttcccttgaatttagctacgttttcccatagatcggtggccggataatatttccaagtgtcgctacgtaggcttccgctctcaccgcaagtcagataagcggctccatcaatcacgaaagcaaccccgttcgtacgtgtgatcgtataatcatcgtcataatcctcgtccgaggaatccgatatatccctaagttgggtccatgattccgtgctgggatcgaatttccagaaatcgtctacatattcgccgttattttgtccgcaacatacataagcgattccatttatcacgaagctggtagcgccctgacgctttgtcccgccgatactgatcgtttgcgtccagctatttgccaccggattaaaggcataaaagtcttttaggtaattcccgtcgtatccgcatccgatatacgctttaccgtttaccccgaaggccacggctccatatcggcccgagccggggaaatccgctttctgtgcccacgtattggtggtcgggttaaattcccagaagtcgttcaagtaattggtaccgtcgtatccggttcccagatatcccttttcatctaccgccatagctacggccgaattgcgggcggttccgggaaagtccgccttttgcgtccaagtatctcgttccatatcatattcccaacaatccgataaacgattttttccgtcgtttccgcaaatcagatatcctttgttaccgatcgtgaaagaggaggcgtaatttcgcgccaatccgtccatgtcagagacacggtaccacttaccgatcaaatcatcgtcatcgtcatcactgcaagcgctgatgatgacaggaagaaaagcgatcaagaatacaagaatccttttgtgtatcattctaactacgtattttgtttttatggaagcaaaagaacgagggttttacgagacccacaaattaaatcggtaaacatacggtttttatcggtgaataagccggattgataggttagggcctcgaatggttttgaaatcggtttcatcttcagtatcgggccgtttacagaggaaaccggtgggttcatgggtttatcttgccgggttttgcactaaatacgttctttgccatcggattgataaaagattattcgcttattaaataagaagtatggttagaacattctttgctttggggggcttgatgctctgtctgggactgttttcctgttatgacgagaacggtacgtatggcagcgatctggtggactccgctttccgtaacgttcgtatagataccagcacggtcgtagtgacctcggtattgatcgactcgttggagacatctggtaagaacgtcgctttggtaggccggtacaaacattcattatggggagtcgtctcgtcgcatagctttatcgcttatgaaagacctagctatgggactgatccggacgagacggtcgtactggactcgctagtcctgtctctcgctttcgacggtcgctttgtaggagacacgaccctccaacaaaccctctcgatttatcagctaacggagaagatcgtcttaaacgataacgggtatttatataataatagcagtgtctcttacgctcccgaggctttggcggtctgctcatttaaaccgaagccgaaggggggggagaaactggaagtccgtcttcccgatgcgctagggcaagacctcttgtcccgttttcatgcgcaggatcaagcggtgtccgaggagcgctttgaggattatttcaaaggggtggcgatcgtgccggacttggcaggaagcgagtctctgctgactttcacggtagccgattcctccgccgctttagtcctgcattatcatttgtccgatgagctttccacagagaaggaattatggttcttcccgaatacggatacccagttcaatcatattgaccatgaccgtagtggaacggatatggcaggatatccgatgaaaggagtggagataccttcggccgagcttggtaaccggggcgtattattcggaggcttgggttggtatacccgtctggaattcccgtatttgaataatctgatgcaacaaggcacgcaagtggagattgagagcgctttacttaagatttatcccgagcaaggcacttattcggattacaataccttgccggacagcctctacctatatatcgccgatgagaataatgtggtgacggatgccgtgaccgattatctcggttccgaggttcaacgaggtacgctatcggaagacaatacgtttaacgagaacacctattattatttcgacgtgactcaattcatgcaagaggagctaggtgcctttggcatgtataagcataatcttcagttggtttttaatagtgatgattacaccggcacgttcaagaacttgacgtttaacgatcagggaggacgtaacccggtcaccctacaactcatttataaggtctatgaaagttactagataccttctttacccttgcctcttgatggcggcaagcgcatccgcgcagaatacgatgacttcctcgccttactcgatgtttggactgggtgagatggcttccggtttatatggtcaaaatacctcgatggcgggtgtcactgtcggcatgcgggaagggatgctgatgaatatagagaatcctgccggattgacagcgttggatagttgtaagttgttcgctgaggcatctgccttcgtgaagaatgaacgataccgctcagacgggagctctagcagcgcattcaccgggaatttctccgctttctcattgggagggcgtatcatgcgacggtggtatatgtccgtcggggtaactccttatagtttcgttgggtattattttaagtcctcgcaagagttggaaggatctcccggaacctttgtaaccagtacgttttcggggacaggcgggctttccaaggctttcctttcccagggatttttattgaccaagcatctatcagtcggtatgaatcttaattttatcttcggaaatatgacactgaatgagatacaaagtgcgatgacagtgtcaagggagatgtccggccgctctttttacgccgatttcggtttacaatatcatcgtccgatcgcccgggaaacctttctaacggtcggcgccatttacggttataagcaacggatctcattgaaaaatacggtgacggtgacgggaagcaacacggaaaccccctataaccagaaaagggtgacacaatatctacctcaatatataggcatcggtagctcattggcgcataaaaaatggacgtatgcgttggactatctattccggcaatacggggtattgaactcgagcgatagccgggtaaagttccgggattcgcatgagctacgcttgggcgtatgctatttcccgaatggatttagctccagcagttattggaaacggatgtcttataaagcgggtgtttctgtttccacgccttacctgcggttgaaaggacaatccggcggggcgtatcgggtaagcgttggcttgggattacccgtcctgaatggccgtatcaatacggcgttttattacgatcgtctccaattgcaagggaatgcgttgcgaagagatatcatgggctttacggtgacctatacattaagcgagaagttctaccaagtgaagctttagttttctgcctatgaaactaaagtttcttcactaggaaacaaaagttttgtcacggagaaacaaaagtttcttccgcatgaaactcttggttactcttggagagccagattattcatcaaggcgggcaggtacgaatcgctgatagggatcagttcctccccgatacgtatccgcttgcgctcgatataattaatgtgggagagggatacgatgtaagaacgatgtacccggcaaaaacgattcctgtccagaaactcctcgaaccgcttcaagctgacttgcgtgagcaggggcttgccattgatacggtgtacctttacataatcgccgtatccctcgaggaaaaggatctcttcccggcgaaggcgaatgatcttgctgccctcccggacgaagatggggcgttctgtttgctccttgctcagcacttggtggacatcggccaaagccttgtccagtttctcgagatatcccatgagcgtgttcagggtcgaggcgtctccgtcgaaagtgatacatttcagcatagtgtttttacctttatttgttgtaccgcgaaataacaggaaagttcggtaaagaaaggttaagcgccgattagtggtataatcgggtcggtgaatcgccttacgggagggggtgaaaagacattattcctcttccctcagaatccatttcttgaagatcggggtcttggtcttgctgatgatgatacgttcgggaaccggcaaggtgaggttgacggacaggcggctcccgaaccaaagatctatatccttgatggcgttgcgtgaaatgatgaattgacggttggcccggaagaaaagcctctcgtccagttgctctcccaacgcgtcgagggtacggtctacgggatgttgcttcccgtcggaggtataggcggtaaccttctcgttggccgtatagaaataaaggatctcctcaaccgccaacggatagaatttatcggccagcatgatcaacaggctcttgatcgtgtggcgactctggatcgtacggttcgtttgccggatatgcgccagcctttcctcggtatcgaacagccgtaatttattcaaggccctttccagcgaggccagcgtgacaggcttcagtagataatcgatactgcttacttgaaaagcctgtaacgcatactcatcgtaggcggtcgtgaagactactggggcatctatctccacctgctcgaatatcttgaacgccgatccgtccgctaaatggatatccatgaagatgatatccggatgaggcgatgtccggaagaaatccacgctctcctcgatactctccaactcggcgatcacttcgatctgagtaaccgtattttgcgccagaatcgcctttaggctattaacggcggtagtctcatcttctataataactgctttcatgagtgaatgggtttattaagtaaaggaagcgtgaccttgaaatattccttgcggttggagatctggatgtcctttccggtaagcatccggtagcgcccccataggttcttcaatccgataccgctacctttgctatcttccgacttaggatgtattttattggatatgattagtttgtcctcatgggtggtatagatatcgatctgtagcgggtattgcttgctgataacgttgtgctttacggcgttctcgatcaaggggagtacgctcaatatcggcagataccaaagcaagtaaggggtatccgcttggatggagaagaatagctttccctcgtagcgcacgctcagcagataggtgtacgcttttacgaattgaagttcttccgccagcgtaaccagctctttcttgttgctttgcaagatataccggaagacgttggatagctcatccagataagccagcgtctgttgtttctctccgctctgtatcaaggcgttcaatccatttaaggagttgaaaaagaaatgtgggttgatttgtcccatcaaggcgttataggaattctgtaacttctcggtcttcaattgctcatattccagtttcatttgctgcttgctgcccagcagccggatcagtatggagcttagcatgaccgtgaggaagacgaaaagatgctccgtcatgaaagagttagggaccgtgaaaggattgggcggtaccggtatgtcccgatgctcggcaggcctgatggtttgcgtagccatcctgtcccggttgatgcggatcatgatatcccgggtagctggctgaggtccgtcttctcccagccattctacaacaatggccgtgtacaaaaccggcgacagatgaaacatgccgtaggcgatgctgatacaagttacgcaaaccaccaatacccttttatactctttcctgcggaaaagcttgtccccgaacttatacatcaagctgttgacaataaataagatgaaggagaacacgaagaaccagattagcaaataatacatggtgcgatccggaggctggatacccatgttcgggtttccggtctcgaactcatatttacgcatcagaagggcgaagttcacgaaaatactaagcaagacggatatcgtgaagccgatcaataagtcgtttctttttaattgtaacatagataaaccctttgtctgcttacaaagatagggcttccttatccgagcgggaaaaggaatcgacgaaacggataaaaatatcggtgaatcgcccgggcttccgaaaataatgtacctttgctggaaattaggatctctgttgctatgacgaaatggtttgtctacatatttctggccggtgtctgcctgttgctttcctgtggcggtaaatccgtacgggagaaatttgcggaagcggaccggttggtaaacgagaataacttagatagtgccgcttggctgctggaggagcaaataacgctttccgctctttcggatagcgataaggcagagtatggacggaggctcgcttggcttcatctcttgcaggggcgcagcttggtgaacgactcgctcatcgactactccgtggattattataaggagcatgcctcggagcctttactttccgcttatttcgtaaaggctatttatatgggtgattcccggaaggggttggaacaaagacgtgctttgtaccgagaggcgatagattccgcttattcccgttcggattcgacctaccttgtacgtttttatgaccgattgacttccttgagctttggtgaggggttgtatcgggaaacgatcgcagactcgaaggaatgggaagcctcgccaaaagctggatttaaggagatggcctattatatggccgggttgagttatagccgcttgcgaatgagggactcggcggattattatcttcgtttggctgcggactcggccttggctaagaatatcgaatggtatgcccatcattttgcccgtaattatgcggatttcttgtatgattttaatcccaaggcttctatcagctatttacgtttgttggaagaacgatatccggagcgagagaccccgggatcctatgttatgccttggatcaatctaggggaattggattctgcccggaagtatatcgagaagaatacgttaggcttggaacttagtcacagtgatgatatagcctcgcatgcgctgaattatgcctatcaatttatattgggcgtaaaggaaaataaaccggtggatatttcccggttagggcaatattgcgattctttgtataccgtgaaatcccaaacggagaaggctgagcgggaacgattggtcgatcaaaatcgtttacgccgagaaaatcttcgcttggagatgagccggcagcgtacgttctctatcttggtgatcgtttccttgctttccatattggtagctggtggagtttccttatatatccgtaaccgaaggaatcgtttgattgatatggaggagcgtttggaagccttgcgtcagctcttgaacgagtccaagcaatccgtagcggaggagaaacccgatagtgcctttttccgtaaggtcttgttgcagcaattgggtgttatccgcttgatggcgactactcccacgcaacaaaataaggaattgctccagcaaatgactcgtatcacgaacgaggatgtcccggtagatacgcttttggtatgggatgacctgtatccgattatcgacgcggtctatgataatttccatacgcatctggtccgattgtctgacgggcgtttgctggaaaaagagatccagctttgttgcttgctatgcgccggcttctctaccaaggaaatcagtgtagtcacccaacaaagcgtccgtacgatctatcagcgcaagacggacatccgccataagctgggtatggacgagaaagaggatattatcggctatataagcgctcaaacggccaatataaacttttctctctaagtagctcggcaatgctctgtaaatcagcgtatgctgaaaaggcttcgcactttagtttctagcctgtataaatcgattatagcggtttccctccttacatttgtctcgaatcaaatttgaattttatgagaagacaagtattatttgtgggattgatttgcgttgcctttttggtaaacgcgcaagaggagaaaacgatcgatttggatgaggttaccattcaagcctcttcgattataagaaagaaagaccgtcaacttatattcccctctaaagaccaagtgcggcgctcgatggatggcttggatttgacaaggcggatgtctttacctcgtctatgggtagatccgaatacgaaaagtatctctatggcgaatggaaacgttcagttgcgtataaatggcgtgttggcttcttccttggaagtcgcagccctctcgccggaggatatcaaacgggtggaatatcacgataatcccggcttgcgatatggggaaggagtcgatatcgtcttggattatataacgatcaagcggacttccggaggaaatctcggcgtggatttaagccatcaattaaacacgttttggatggcagattatatatatggtaagtataaccgaggacgttcggaattctctttatccagctttgcgaacggacaccggtataaagaggcatggcaagaccggacggaaatctttcataccccagatggtaccttccagcgaacacaggaaggaatccccgggagggattatgagatgtattggactacgacggcgaattataactacacgaaggatgatgattatttcttgaacgctaagctgaatttttattattatgactatccgcataactatagcagtgcccttttaaggaatagcgagagcaagatgacgaccgatcttatcgataataataaatccttgaatacccgtccctcgctcgacttgtattatttccggaaattaccacgtaaacaatcattggctgtcaatgtcgtgggaacttattcgaataccgatagccgtcatacctaccgggaagaactggaaagtattcctttgacagatatttatacgaaagtagatggaaagcgctattcggtaatcggagagggtatctacgagaaagagctagagaccggtcgtatttccgccggtttgaaacatacgcaggcttatacggacaacgtatattccggttccggtgattatacgacccatatgacggaatctgaatcgtatatgtatgcgcaatacgtaggaacttggaagaagttggtttataacgtaggtttgggcgcctcccgtaattatctatcgcaagaaaactcgggctcttataatcggtggtatttccgcccgcaggtaacacttacttatactatcaatgaggtattatccgctcgttatcggtataccctgcgcaatgtaaacccatccttgtctgagttgagtaacgtggagcaatggattgattccttacaggttcgtagaggtaatccgggtctatcccctttcttatatcataacaacgccgtggaatttcatgtgaatacggcaaaggtcaaggccggctttactttctcttaccaataccagccccgcatagtcatggaagagaccctgtatgacgctagccggggactttttatccgtacctacgataaccaacggagtttccatcgttttacgccggaactgtatttgaattattcacccttcggcgattatctgcgcatgaatatctccggaggcttgaaccatttccaatcgaatggaaatagctattcgcatacatacacggatcccttctatgtgatctctttgaatagcgatgtgaagaactttaattttaacctgttgatttataagagaagctatagtttttcgggtgagaccagtcgtgaggccgatcgttttaataggttgggtatcggttataggatcgggaaggtccagttaagcgcttctttctctacccaatttacctcatccgcccgttaccggagtaagaaccattcagcgatcgctccctatgtgaccgatcagcgttttggtgatatttatccgggcttcgagattggattctcttaccacttagatttcggtcgcaaatacaaatccgtggatcgtaagttatataattcagataatgaatcgggtatattgaatagtcggaagtaagttacatctatattgtcgattacgtgttcgcggctttcagtatgcaatatatcataattgggtaggatatagttctctatcattcctacccgtttcatgcgtgcgaacacctcttgataaggctgccccaatttgcgtgcggttccttctatacaaaaggaagcgaacgctagctctatttctgtttgcgatagttcgatttgtttatccatttttccatgtcgcttaggtgaatttgcttcaaatgtacgtaaaaagtggctcatgcgataaaatccgtggatgaaattatctataaatgggaattccgtagaggtagtacttactttaccgatgaagtatatctcctgtggaacttgaagtatatctcttatagggaagggagtggtatctcgtgaaaatgacttttgatgaacccttgttttagagcatatcaaaattatctgtcagcgatatttattcatgaatcgtgggcgacttggatatatgatttctttcaatgcccattctaaggttcttataatgcccatcgtaagctcctttgaatgggcattgttagatgcttacgatgggcattgtaagaaacgataaacaaaaagccatccggcattccgctggatggcttttcgtatggcaatagaatcggagagattacactctcttttctttgattcttgctttcttaccggtaagggcacgcaagtagtacaatttagcacgacgtactttaccgactttgttaaccgtgatgctttcgataaacggagattcgatcgggaaaattctctctacacctacgttctcagacatcttacgaactgtgaaacgttttttgtcgccgtgaccggagatacggataacaacaccgcgatactgctggatacgctctttgttaccctctttgatacggtaagctaccgtgatcgtatcaccactcttgaatgaaggaagttccttcttcgtagcgaacgcttcttctgcaatcttaattaaatccattgtttatagctttttaattgtaatttataatgaaacgcaatttaacgggctacatttcccgacagagattacgtaaagcgggtgcaaagtaacgaaataaatatttgattcgcaatagatagatgcttttttgctcgctatttgattaaatcttttatgtctaccaaggattcaaaccattgacatccaccagcgattcccgttcctccttccacattgctgtagattcggacaggctcggccagacctacattcgtaagtccgcccatgataccttcattcttgatgttttgtaaagatagcagatattggtaatagggttcggacagggaatataaacgaatatggcgtttggtataatatttagtatcggacctaagttgttcttttacttgcaacgtgtattccttcccgtcgaacagctcgtcggaaaatacccgtccccgccaatttaccatcgaggagccgaaaacctcatccaagataccttgttgctgcgtgaatacgggatctacggagaagtccaacaggacaccaagatggtcgtcatctccccatatctgtagagaatagtaatttgatttacccggggtatcttggaaagtgatttgatagataagcacatcgttttcttctatgtaggagatattcccatctccatcgacaagggtaccgccgttgccggtagcttctttacggggaattatgcgcaggcctttgatttcggtcttggaaggaatcttatcttccgccgaggctgttccatattccggggtggaagctacaatctttacggtttgtccgggctgtggaaccgtattcgatatataaagcgtatctgttacccatccacctcgatcctctccgagccaacgagaagatttccaataggaatattctttccaaggcatctcctccttgaagatcccgtctatgtataattccaccttggcgtttcgaatcgttacgtccggcttgctctctgagtgaaaccatgtgcgggatatgctggccattacgactgtatctggcgagaaggccgagttgatcaccatttttggtgtagtacgatattcctctaggtcaaacttcctgtaacaggaggttaggagcatgctggataataagattgataaatagaatataggtttcatgttctttagaatttataagtatatgatatagacggaatgatcggtaagagcgataacgtctcgaaataatggctatagtttatccaagaccgcttatggatagttatcgggttcatctggcaataagcgttatatacgctgatattccagataccgagatggccgttctttttaggtcgataaatattaatccccagatctaagcggtggtaagcggggagacgtacgttattacgctccgtgaaatagtccaagcctccttccggtaagagcggagggacaggagtgaggcccaaatcctcgtaattctcgaatgccaccgtaacccggtttccggtcatgaaagtccagcttcctgttagttccaatttctcgttgatcttccagtttgcgacgatattcagcttatggcggttatcgtatttcgcggggaaacgtttgccattattaatctcgtcgaactgccggtcgctccacattagtccgtatccgatccatcctgttatacgccccgtctctttccgggcgataaactccgctccataggcccaccccttaccggcggccagtttctcctcccaaccgacgaacgagggtaagaagttgtaaccatctttataatccagtaggtgattcatccatttatgataaccttccaccgagaaggaatagttcttgtgcagattgtaataagcgccaacggatacttgatcactcaccaatggttttaatttcttgctgaccggcatccacatatcggtagggagactcatataactttcgctaatctgatgtacgtattgattcatccgggcgtatgaggccttaaggcttagatccctcgtgagcaggaagcgtacggataaacgagggtctaaggagacatatgtcttcttttgtatattgtatatgttcaggcgtaatccggcgttagcccggacaatgggagatatcgcccagtcatcttcggcgaaaacagccaactcattcgctgaaaggcgctcgtctccggtagttcgtttggtcggagacaaattctcggaggtcttttcctcgatatattccgggctgaaacgatggtaaagatagtcggtaccataacggatatgatgtgccaaggtaggaatatagtcgaagttcgcatggactccgaaatcattgataccgtttcgggttgaggtctcgataaaccgtgaagaataatctttgtcaccctcggttccgtagtattgtgaagtctcttgttttagtttggattgataatgggaataagccaaggtgacggtaccgaacatcttgttgttaaacacatacgaccagccggaagataatgcgatgttaccccagcgcatctttccaaagtccttgttctcgaaaggggttatatcatcacctacggagaactcagaacttcctccttttaggaaatcctgtccgaaatagaaattaacgtaagcttggctccggtcattgatatggtggttcacttttaggttcagatcggtaaaagcatagcgtgcgctgaatttctcccccttctttttctgaattttattgtagatcgccaaacccggtgcggataaggcatccagccaagagcgacggaaggaggcgttgaacgaagtccggtctttaatgatcggcccttcgaaatttaagttaccggaggtcaatcctagcatagcgctaccatggtactctttcatattgccatctttagtatgcacatccactacgctggaaagccttcccccatagcgggcggggaaagcggatttataaaaatccacatctttcaaagcctcggcgttgaaagcggagaaaagtcctccgagatgattgacctgatacagttggattccgtctatcatatacaggttctcgtctccattccccccacggacatacatcccggctaatccttccgttccggctgatacgccgggttgggtttgcagggctttgatcacatcagcctcaccgaataaggtcgggatggtcttgatcatcttccgggttattttaatcgttcccatctgaggggcttgtatcgggttttgtgtgtcattactaccggtaacgacaacttcggccaatgcctcaccgctttccagcagaatttccatcacggtatcccgttcgagcggttggaatgtatgtgagaaacgtccgtatccgatgtaggaagtctccagacggactaccccgaccggtaaggttagactgaagaaaccgtggttattggtagctgtgcccctttgtgtgcgagagtcataaacggaggccccgattagatattctgtagtcgctttatcccgtacgaatccgctgatggttactgagcgggggagtttcttcaagatgatgtgggtaccgtttatctgataagacagagggagcttttggaatagccgggtaaggcattccgatatggattggttatcagatttgaatgtaatccgggaaatacctttgagaatagaaggatcgtaggagaatgtcatgcctgtttgatgctctatttttttcatgatttcttggatcggttcttgtttagcctcgatactgagagtcggcgcctgtccccaagcgcttgattgaaagccgaagataatcaagattatgagtagtattagcttcatgaagtacttccttttttattacgagacaggaaagatagtaaaaacccctatcacaattcacgttactattgcgatattttcttatttttggagagtaataatgataatgttgtgatgagacagattggtatcttgcttttgtgttgtatttcccttttatcgagtggggcgcaaacagtcccgaacctttatcgtgcggtggatcaggaaaagatgaatcattgggttgattccgtgtttgacgctatgagttatgatgaacggatcgggcagttatttatggttatagcgaatcctaaatccgataaccggaatatgcaacggctcatgcgttacgtgaacgatatcaagatcgggggcatcttattccataaaggggatccggtgacgcaggcggaggtgaccaatcgtttgcaaaaggcttcccggattccgatgttggtctctttggatggggagtggggactttccatgcgattaagtggaaccacccgtttcccgaaaaacatgatgctaggcgctatcgaggacaatgccttgatcgaggaatatggaaaagaggtgggacggcagtgccgggaaatgggaattcatataaatttcgctccggatatggacgtgaatagcaatgtggataatcccgtgatcggcctgcgttcgtttggcgagaatccggaggctgtgtcggagaaaggtattgcttacgcaagaggattggaaaatacgggcatcttgtctgtctccaaacatttccccggacatggagatacttccgaggactcgcacgagacattacccgttgtgcgccataaccgggcccgcttggatagcgtggaacttcttccttttaaacgttatatatatgatgggttcggcgggataatgacgggacatctttacgttccagctttggataaaagtcataagccggcttctttctccaaggcggtagtgacggatctattacagaaagaactcggttttcaaggtctgtgctttacggatgctttagcgatgaaaggggcttccacaaagaaaacggataatccttcggtgaaggctttgcttgcggggaatgatatcttgctcgctccggccgctccaatcaatgattttaaggccgtgaaagaggctattgaagaaggggtattggatctggaagcgatcgaggccaagtgcttgaaaatattaaggtacaaatatatcgctggattgaatgcctataagccggtcgaaacaaaaggcttatcgaaacgtttgaactctccgcatgcggcatggatggcggcgaagttgaattcggaggctattaccgttttgaagaatgaggatacgatcttacctcttaaacagttgaataagaaaaagatcgcggcgctctcgattggagacggggttggtaatgaattccagaaaatgctgggcgaatatgattcgatcgcttgctttagcatcggacggcgttctacggctgcccaagtccagcaggtttataataaattgcaaaaatacgacgtgatcatttgtggcgtacatacgattcgcattcccgagagtttagcgttgaggcagttggccgcgaagaaagagttggtctatgctttctttaccttgccatatgcttgtaaggaatataagaagtcgatcgagaaggcgaaggcggtcgtgttggcttacgagggcactcccttagcgcaggaatatgcggcccaagtgatattcggtggtattgcggcgaaagggaaacttccggtttcgattccgggattgtattatgcgggtaccggtgtttttacggagaagactcgtttggggtatcaccagccggaagaggtaggagcgaacccggaccgtttggatgtaattgagtcgatcgttaaagagggattggatgagaaggcttatcccggatgccaagtgttggttgcgaaggacggcatgattatctataataaatcgtttggttattttgattacgaaagtaggcagccggtcacggaggcgtcagtttatgacttggcttcggcatcgaaggcggcggggactttattggcagtcatgaaagcgtatgatgagaagaaattcaccttgaacaataagatctccgattttataccggagttgaaagagtctaataaaaaggatttatcgataaaagagttactatatcatcaatcgggagtgactccaactattaatttctatctggatgctattgataaggatagttataaaggcagtttatatagttcggcgaagaacgccacgcacccggttcgttttgacgctaaaacgtatgtccggaatgattttaaatatcttccggatatagtatcagatacacggaaacccggatttacgactgaggtagcccgtaatttctatgtgagtgattcctttaaagatacgatccttcaagatatcaagaaatcccgtttgggtacgagaggtaggtacgtatatagttgcgtgaatttcattatgctgaaaatgatggtggaaaatctgatgaaatctccgatggaccagcttcttcgggatgatttctacagcgggttaggggcttggcataccacttataatccgttgaagcgaatggataccttgcaaattgtacctacggaacaagatggatttgtccgccgccaattgcttcgcggatatgtacatgatgaggcagccgcttttcaagggggtgtttctggaaacgccggattattttcgaatgcgaatgatttggcgaaggtgctccaattgatgctaaaccaagggacttatggcggcgagcgctatctttctttggaaaccagccgtttgtttacacaaagcaagagcccgacttgccgtagagggttaggctttgataagccggtgattggtaatccgaaagcctcgccttgtggggctttggctcccgcctcagtctatggacatacaggatttacgggtacttgtttttgggtagatccggataaccagcttatttatatatttttgagtaaccgggtgaatcctagccgggcaaataataaactgggatcgcttgatatacgtactcgcatacaggatgcgatctataaggcgattgataggaaaagccaaaaagattcgtaattttgtgacagttttaacagataggtattaattaaaaagcaggtatatgttatacggacacggtgatgatttttataacgcaaagaacgaggtaaagataaactttagctcgaatgtgtggcacggagctaatttagataaactgaaggaacatttgatcgagcattttgataagctgactcgttatccggagccggacgccgctactttgaaaagattgttggcccgccggtatgagatcaaggaagagaatattgtagtgacgaatggctcgatcacggctttttatttgttagcgcaagcttggcgaggtgcgaaatccatgatcgctattccttctttctctgaatatgaggacgcttgccgtttgcatgagcatgagatctctttcttcccgacatcggacgatttatcagagttatccttggagggacaggatttctgttggatttgtaatccgaataatccggatggaaagctgatccaccgtacggagcttctccgtttgatctcggcgaatccgcagactaccttcattattgatcaggcatacgtggcttttacgacggaagacatgctaaagccgagtgacgtgaaaacgcataagaacttaatccttgtccagtctatctcgaaggcttataatatccccggcttgcgtatcggttatctggtcgcttctccggagatcgcggagaaagtgaacaagtatatcataccttggtcggtaaatgctatcgctatcgaggcaagtaaatatatcttgatccatccggcgcaatttacgttgccgatccgtaaatggcagcgtgagactgcggattttatttatcaattaagtaaattggatggcttggaggtaattccgacctctacgactttcttccttgtccgtttgaagaagggcacggccgctgatttaaagcaattccttttagataattacggaatcttgatccgtgacgcttcgaatttccggggcttggatgagacttatctacggctctctacccagaagtctgatgagaaccagatcttacttgaaggggtgaaggtttggttggagcaacaataaattgaggacgagaaacttccggaggtatgtgggtatttccggaagtttttgttaaaatagccaaccaatgaacaggggcaagtagtctttcaactctgtctttaatatttcaatcgccttatttttatatctttctactgtccgtatggatatttgcatatcctccgcgatctcgccgtaactcttattctcaaagcgattcttctcgaatacatatcgatagttttcaggtaatttagcaagtgcctctcgaagtagggtttgtaattcttcccaagtataaagctcctcgccactttccgcatagatagggatttgctcttgagagaactggtctacatattcttcgtgattgcgttgcagatagttgagactgtggttcttggtagctgtgatgagataattgcgcgcggaagttcttattacgatgcgtttacgattttcccagatggaggaaaaaacttcctgtacgatatcttctctcgtttcccggtcagagataaaacgtttggtatatatgcaaagagccggataatataactcaaataaacgttggaaggagagcttattatcctcggtcgtgatttgccgtaaaaggaaatcgatatcagtcattgttggatttctttccataatgggacaaatgtatatatttttagaatatattcccctttgtttcacaagctaaaatccttgctttttgtgcaattggtgaggagggcccacacatatatacgtgttgggcaatacctgcttaggtgatttccttgctttattgtggggtacaagaggaagaaaaatataaaaaaagtcgttttgctgtcgtgtttttgttttgactgtgtctatatagaaaaagacaatcatatatgcgagaaagcggagacgaaaaaagtacattacggcagattgagaagattaaagctctgtctgaggatatgctagaataccaagcgatagatgtgcataaggcttggcaaagcatggaacgtcgtgctaagcggaaagcctctatgaggatgttttcgttgttttttacccgtgccgcagctattcttgtagtaccgttgctcatatcctcgttatttttttcttatttatattataccacaggtaggaatgttaagacgggggcatctgtggtttttgcggagattagttccatgcctggtacaattacccgtttggtgttacctgatcaatctgttgtttggttgaatgccggcagccgcttggtttatccatcggtctttgatgagaaagaacgtaaagttcagctctttggtgagggctattttgaagttgaagccgatccggaacatccttttagtgtgtctacctctgagggattgcgggtaatagcgtatggaacgaagttcaatgtgaatgcctatgacgatgaaccttttatcgaggctgtgctggaaaaaggaaagatcgatgttatccggaacgatgaacggatccgcttggaaccgaacaaacaggtcgtgcttaataaggaaagcggtgtgttccgtgtttctgctgtcaatttggatgagaagatggattggagaaaggggcggatggtatttcgaaatactcctttagagaaggtactaaagcgactggaaaaacgatataatgtggagatcgtactgcataagaactcgaatgcggagtataaataccgtgcgactttcacaaatgagaccttggagcaaatattggattatctaaaacagactgcccctattgaatggtctgcccgacaactttcctctcattcggattccacgtttgtccggcagaggatagatgtttatcaacgataaaaaatcatttcaaaataaattttgtgtaatcactaaatctacatgcttatgagtgcatttcatttacgtaagaggaatcttactcggtatttacctcaatcgaatcgtatcttaaatcttggtacggcatttacattcttgactgccttccagttatatgcaggtacctcttattcacagacaacaacactttccttgtcgttgaaaaacgctacgttggagcaagcgatcgatcggatagaggaggaaacgggttattcattcttgtatgcggatcatgttttggatgtgagccgtgttgttaatttagaggccaataataaggatattaatttggttttatcccgggtcttcgataacatgaatgtcgattacaagattgtggataagcagattatcttatcgcataaattagaatctattcctttggcgcagcaacaaggacatacggtacaaggagtcgtattggattcgaaccaagaaccggtaattggcgcaaatgtattggtgaaaggaacgactgttggtacgattacagatattgatgggcgtttcacgctggaagttccggataatgctgtattggttgtttcttatattggttatttatcaaaggaattagtacccggatcaaagacagatttgactatttcgttgaaagaggactcacaaaacttggatgaggttgtggtcgtaggttatggtgtatcccgtaaaaaagatcttacaggcgcggtttcggtcttgaagatcgatgatttgaaagatacaccggtttctagcgtagaccaaatgatgcagggcaagctctcaggagtgaacgtgatgccggataatatgccgggtggaggagttgcggtgcgtattcgcggtttcagtacgatccgtaacaatgatccgctttatatcattgatggtattcctgtggatggtggtatcaatttcttgaatccaaacgatatcgaatctatgcaggtgttgaaggatgcttcctctgcctctatctatggagctcgtgccgctaatggtgtcgttatcatcaatacaaaaagaggaaaagagggtgaatttaatgtcaatttagatgcttactttggtgtacaaaaagcggcgaaacaattgaggatgttgaatgcgcaacagtttggcgatatgttgtggcaggcaatgaaaaatgatggaaaaactccttcgcatgatatctacggaaatggtgatcaggcagttgttcctgaatatttggatagtgatcatttaatcccttctgatgacgtggattgggtcgatgagattttacgtgcggccgtagtacagtcttataatctctcttttacgaaagcggataaaaaatctaatcaattattctcgttgggatactatgatcagcagggattggttaagtttagcgattttaagcgtgtgagtggtcgttttaattccgagtataaattgtttgatgatcatttccgtataggagaaaatatctctctttctcattcttggggaactagtgtctctaacaatgccgccttgggaggaactttgtatgaggcttataaattccagtctatcacgcccgtgaaaaatctggaagatgagtatgccggaaatgtattctcggatattccgaatcctatgggtaaattgtataggaacaaggataatcaagataagaagagccgtttggtaggtaatttgtatgccgagttgcatttgttcgatgggcttatgtttaagacctcttttggtgttgattacaataatctgtatagacgttctttcagtccaaaatatgatgagttgaatgcctcggagaaattaagtagtttatccaaccgaaatgcttggaattttaactgggtattcacgaataccttgacttataataagacatttggcgaccatacgatcaatgccttattaggtatggagtctttgagaaatagatatgagtattttacagcttcaagagacggttttccgtcagacgatcctaacttccgttttttagatgcgggagatgtaggaacccagaagaactcgggtgctgctacggagtatagtatggtctcttatttcggtaagctcgattataattatcatgatcggtatttggtggcgtttactttgcgtcgggatggttcatctcgtttaggtaataacaaatggggtaatttccctgcggcatcagttggatggcgcattagtaatgagccgttttttgatgttgaggcaattagtaatttgaaagtacgcgttggttggggacagaatggaaactcggatgttccgtcgtatgcgacgattgactcatataagagtaattctacgaactcgaattacccgattgatggaaatcaaagtggtgtagatctaggattggtgcagactcgaaacggaaacgttaatttgaaatgggagacaaccacacaaacgaatgtcggtgtggatttgggttttttgaatggtgacttgaatttgactttggactattttaataaagataccaaggacttattgtggcgtagagccttacctgcctcgatcgggggaacaaatatgactgtttgggataatgtaggtaagatgaacaacaaaggttttgagatggagataaattatcaaaagcaaatcaatcaggattttggtttctctgtcgcatataacttctctgttatcaagaataaaatgaccgaactgaatggggtggattatataggtctttccagtagtgaacttcacggacgtaatttcgatcaagagacttctcgttcagcggtaggacaaccgatcggatccttcttcgtgtatgaggctgatggtctgttccaaagcgatgcggagatccaaaactataagaatgatagaggtgagttattacaaccgaatgcgaaaccgggtgatattcgcttcaaggatttgaatggagatggcgttatcaatagtgatgaccgcgatttcaagggaaatccgttgcctgattgtagcatggggttgacgttgggtttcaattataaaaactttgatgttagtgccttcttccaaggtgtatttggtaatgaggtctataatttgacgaattatttgggtgagttttataaccaggctcaatataataaaaattctacgatcttggatgcttggcgtccggataatacggatacggatatacctcgtgtcacattggatgatccgaataataatattcgtccttctacctattatatccataatgcctcttttgtctgtttaaagaacttaaaggtggggtatacactaccggataaagtagcatctaagttgaagttgaaacgtacgtatatttatttgcaaggacagaacttgtttaccataacgggatatgaaggtattgatccggaggttggtttgcagagttattcttctgagaatcgtaatttggatatgggggtggatcgtggagtgtatccattaccaagaacatttactttaggggttaacgttagtttttaacataaaaagagatatatacaatgaaaaagatattttattttgcggcatcagcgttgatgatgtgttcttgtgcggactcattcctttctgaggagcctgtgggtgagttcttgcccggacaggtagagagtgaggaaaatatagagggtatcgtgaccggtgcatatgctgtgttggatgggtattatgcctctgatgcgattaattccggttgctcaaactggcagttcggggatgttgtctctgacgatgcgtataaaggtggcggcggtaccggtgaccagaaccaaatccatttgatggagatctttaatgcgaatcccacagggattgactttgaagctcgatgggctgctctttatgagggaataaaacgttgtaaccaagcgattcgtttattgaatggtagtgaggttaaaaacaaggaacagcgtttagctgagatgcgctttttgagggggcattattatttcaacttaaaaatcatttataatcagattccttggatcgatgaaacgttggtggatccaaatgaatacaataagaaatcgaatatcgagttttcatccgatcaattgtgggagaagattttagaagagttctctgctgcttataaagtattgccggagagccaagcggattatggccggcctactaaaatggcagctagagcttatatggcaaaggtttatttatatcagtccaagtggaaagaatgtttggaagcttgtgatgaggtgattcaatctggaaaatatgagctattccctgatttccggaatgtgttcttgcctgaaaatgataattgctcggagattatctttgcgatccagctgtccattaatgatggttctcccaataatgagaacggaagttatggcgatcgcttgttgcctccgggaggtccttatcctgtatatggctttttgcggccgactcaaaatttggtaaatgcttataaaacggatgttaaaggcttgccttataatgatggtaaagatgtgtcagagaatgactatgtagatgttcgtttggatcatacattagctagaccaaatataccgtttatggatgtacaattgtatgattggactcctagagaggctagtgtgtatggcccgtatagcccgaagaagcgtttggtttcattgaattctacttattattcgccgatatggccttatgtgaatgctttgaatttctatgtgattcgttatgcggatttgttattgtggagagctgaggctgctattgagacaggtgatttagagactgggcgtaagtatatcaatatgattagagagcgtgcgaaaaatactcagcatgtcaagacaatggatcaatcacaagatgctgctaattataaggtaggggtttatgatgagccttttaaatcaaaaaatgaagccgtgcaagcgttacgtatggagagacgtttggagatggcgcatgagggaattcgtttctttgatttggtgcgttggggtgtcgcggatgaagttatcaacgcttatatcgccaaagagaaagtgttccgttcccacttgcaaaatgctcatttcgtaaaaggtaagcatgagtatttcccgatacctcagtctatgattgatatttgtggtacggaagtaatgaaacagaatccgggttattgataaattaaatgaaagaaaaggcggtgtgtcaaatagtttaatatccatttgatgcaccgctttttcacgatgtaataaaaaatatgaagcagctaggagttattttatatctattgtgtttgactacctgttatgagttatgggcaacccctcataatgtcgcttatcaagctaaagtttcctgttcgtctgccttgagccaagagcaggaaggtaagtatgtgatagatcaggtgattcgtatttccggaaagggagaatgggtagccaagacaaaattggatgcgcgtggtcgggtgtatccgtatccttggatacaattagattgggatcatgcgatttatacgaataaggttattttatacgatcgggtggatgagcgaagccattgtgctgcgggtaccttgttctttagtgacggtagttcggtaacggttaatttgattcccaatgatggagcgccaagggtggttgaatttgatactcggaagacggaatggattcgttttcaaatgacggatggagaaggacaagatttagggctgtctgagatagaggtgtatcctgctcctgagtcttatccggattatatctcttgggtgaatccttatgtcgagaccgctaaaggtcgatattttttctttgtgaccggaagtttgcctttcggtatgataagttccgctccattaacccgcaatatcaatcaaggaggaggaggttataattataattctactaaggttttaggcttccctcaaattcataattggatgatttcaggattgtctttgatgccggtgaaagatgaggtagatgtttgcagaggagataaggtttggcgttcttctttttctcatgatgatgagattgtccaacctggttatcaccgtttgttcttggatacttataaaatatgggtagaacagacggttacggatagggtaggactttatcgttttacgtatacgcaagatggtttggcgaaggtcttggtaaatctgggaggtcatatagctacttctactttgttgaacgctcatgtgacaaaggtgaatgatacagagatctccggatattttgatacggctggtcgtgtatggggaggtgtcgatgtggctaaagtttattttgttgttcaatttgataaacctatggatgctttgaacggttgggttggagatagaaaggaaacggatatcaatagtttgataggttctccagaattaattaccgtgcctaagtcttcttttaaacaatctccttcttctggcgtagaagcttgttttggatcttttaaggctggtgatgagctgttgttgaagaccgctatctcttatgtgagtgaggaaaatgcccgtgagaatatagagcgggaatgtaaacattgggattttgatcaagttaagagtgcgtccgagcgtatttggaatgagtggttgggaaaaattgatgtgcaaggtggttcttttcagcaaaagaccaagttttataccgatttgtggcacgtattgttggggcgtcataagatagatgatagcaatggcgagtatccggattatttgtccggaggagaacgtattggaaaacaaacaaggatacatacgattgctcctaaattccaagtacggactttgcctaaagataaaacaggaaaatcaaggtttcatatgtataattcagatgctatatggttgacacagtggaatttaaacacgttgtggggactggcgtatccttctgttttagacgagttttccgcttcttttatcgaatatgacaagaatggaggtctattacctcgtgggccgtccatagggtcttatacttatattatgacgggctgtccggctacctccttgattacttccgcttatcagcggggggtgtttcataaatggttgcccaaggagggatatgcggctatgaaaaggaatcatgagaaaggtggtatgcttgcctttgatatggataaagagttggagttctatattaaacatggatattgcccagaagaggctggcttgactattcaatgggcctttgaggattgggctttgggagaaatggcgaaagctatgggaaaactcaaggattataattattatagaaatcgttccttgggctggcctgcgtcttggcatccggatttgaggttgatgatgcctagaaaagaaacaggagagtgggtccatttggatcctttgtccgagcgtgggtttgtacaagccaatgcttggcaggctacttttggattatctcatgacattgaaacattggctcgtttgatgggaggtaatgacagcttagctactcaattgaattatgtgtttgagatgtcgaaaaatgcaagattcctgtctagttatgttagttatgccactcaacctggttgctcgaatgcgcacgttttctcacatgtaggaaagccttggctgactcaatattgggtgcgtcaggtcgctaaacagacctatggtgatattacgccagagcgaggctacggcgaaaatgatgaagatcaaggacagatggctggaataagtgcactgatggctatgggattattcagtttggatggaggctctgcctataatccgatgtatgatattacaagccctgttttcaatgagattacgattcgattggattctcggtattataaagggaacgagtttaagattaaagtacatgataactccccagagaattgttatatccagaaagcttctttgaacggagagatgtatcataaatatcaattgccgcataccgtatttgagcaaggtggccttttggaattatggcttggcgataaaccaaacaaggaatggggaactcaataacgatttgggcatatctctcaatttgtgtgatgattcaaaaaaaggatgtgcgtaacaatgaggcacatcctttttcatttccttttaaatctaagtagcgtgtattattctactcgtttgttgattacgatatgaccaaaatagccaaggagaaccaatcccagacctgtaagtagaatactatttgtcatacctccggtgaaaaacggtacagccaaaactgccgcaccaataatgagtacgatcactcctagatttttaattaactcattcatggttatagatattttataattattttcttttctaccgcaaataaagcaataataacccgatcgtgaaaatattttcggagaaaaataatgaaacgattgaaattagcttctatatttgtgttataatatagttacgtatgggaagaatactttacatagtttatttgtggctgttttttgtacctgtatttctggtactgactatacttacggctgtgacggttatcatcggttgtctattggggggagagaaaatcttcgcttattatccgggtatgatctggtctcgattgacttgctatctggcgctttgtccggtgacggtaaaagggcgtgagcatatagaccggaaacaatcgtatgttttcgtagctaatcatcaaggcgcgtttgatattttcttgatatatggtttcttaggcgttcccattaagtgggtgatgaaggcgggtatcgctaagattccgtttgtcggggctgcttgccgtgccgccggttttatctttgtcgataattctacgccgaaggccgccgctcgtagtgttttggaggcggagcgttgtcttcgaaacggggcttccgtggttgtttttccggaaggttcgcgtacgtatgacgggaaaatgatccgtttcaagaaaggggcttatcaaatggctctggatcagcatttgcctattattccgatcaccttaaacgggccgtttgatgtcttgccgatcgggtcgttgaatgtccatcgtcatcggatggagatggtgatccatccggcggtttctaccgagaatatagacacttcccacaaaggaatgcaagcgttcgctgatcagactcaagaaatcatagcatctgccttgtgggaagaatataaataatttaggttattatttccagcttttcaagatgccacgtttcgctactttcaggctgaatccgaagttatcgccgaacatggaaccggcatcagctgccaaagaccctgtaaattcccatcccgataaacggggatgttgataagagatatctaaaagtccggaagctcctcttttcttgctaaggaaaggggtggcatgtctaccccaactattcatcacggtgactaatacccgataagatacttgtgaggagatagagccttccgcaccgaaatgccagtcacgaacacggttgttcttgaatcctaatgaaccgttctcgttatactccggacttgggatcagaggagaacctatcgcccggttaaaataagaggctccggtagtgtattctccgttgttataataatcatcaccaccgccacctacgccgggatgtaggtcgtgatcaaaatcgatgaagtggaactgtccgctttggtctcttgtaaccagatactccacgaccaccttacgcaaccacgggaattttggtaaatccaattgccctccccataatccgtcggtattgtttacgaatatcataccggatttatcctcgaagaaatgttggtaataggcggatacttgccagttaggttgtgtaaaagccaatttgaaatcgtaagagccataatgattacccagtacgttgatttgatcggagactgttgcgtcgccacccccttcgctgccgcaaataacccggataaggtccttgatggattgaggctgctttccgatcttaggattggttgaggttcctccccattgtgcccaatgctgtactccgattacaccggataacgggaagtcattgcgtgtatccttaatctgtacaaataatgatttatgatgccataaaacgttatctacataagtctgcttattgtttgtgaagttagccagataatccttgtcgaaagaacgaccgacggcaaagtctcctttgacttgcatccagcctttcgttaaaggaacgacggtaaattccggaatgctgatgttcacttccggtatcgggcgggcattggcggattgcacgatatcgcccgagctaagccaacgatcccaaagtgaattatagcgttccttgcttcctacactcaatagcaagcatttgtaacctaactcggcatatatttgttggataaagaaattgcgatgacgaggaactgcggccactacgtctaatccggctccccagcgaaaacctttgccaaaagtttgattatggaatactcccgcattcaaatatccgttattcgcttccaaaggaacaattccgtatcgattgctaaccatccagaaaggggtattgtcgccactagctaccgatccgaatatttcggccttgtaggtagtcgcttccggagttgtctcttcttcttgagcgaaactagccgttgccatccccagacaagtcagacctataaaaattgatcgcactgatttcatgtatatataaatgttttgtctgggcgcaaaggtaaggatttatatgtttggtgcaaccattattgtttctttaaccactcgaatatagtttgataggcatcgttccgatagggcttttgagataggatcagatcgtggatgccgtttggaatggtatctctcgtgactttgtctcctagtttctccccgtatttttgaatgtcttgaacatccaagactatgtcggaggtcatgtattcctcatgccatgtctctgtttccggaaaagatttgttggaagacatcactagtatcggacaatccagttttaaccctttttgtaccgtctgttgcgcttcttgtatggctttgatccatccggcttttttcggatgcccgaatatcattttccagttcgtatcaaattcccattctcctttatactgcttaagcaggctataagcgtaattcggatcacccaaaccttgtacggtaagattcggaaatagcctcccgacaaacgcaacggttggcagtacgactttctccattaaccatccgaaattccaatctagaaaagggctgttcagaataagcccgtctaccggtaactctccttttttactattcaaataataaggtgtgatcaatccgcctgtagaatgcgccattaataatatccgctcgttgccttcagaccggatggtggccaaagcggtatcgatatcagcgaaatactcttttaggctcttgcaaaagaacgggttttgattgggtaatatcgaacgtccgtatttccgcaagtccatcgcatagaaattatatccgtgagcgtttacgctatcccctaattgtttctggaaaaaatagtcattatagccatggatatacagcacggcctgttttacgctatccagttgaggtttcttgaccagtgtgcaaactaccttcccctcataatcatccggcatctggaaggtacggcgtaaataaccatctcccaatacatcgggtacgtattgggcatatacctcgcataaaatgaaacagaggaatataataagatttatttttcgagacataaatatattgtttctattttataactgtatttgcaaagatagggtttatcaatcaatggtaattaaccaagatcataaaataaaaaatgacagataagcatgaaaaacgataggataaacgtgaatattgcaacttatacgtaaaaagcactatttatggtaagccgttaattttttatcttaacaataaatattttactttgttggaaaatggaagcgtgtatggaaccggaaataacagtaataatcatagatgatgaccttggatcgatccagaaattgcaaaacgatctattggccttctcggaggtaaggatattagatacagcgacaacggcggaattaggcaagaggcatatccttaagtatcaaccggatttggtgtttttggatgtggaacttccggacatgtctggctttgatttgctggatgatatacgggatgatattcttccgaacttgagagtcgttttctatacggtatacgataaatatatattggatgccctacgtgcctctgcgtttgattatttgttaaaaccttatttaattgatgagttagcggcactcatcgaacgttttcatacgacagaacctgcggatgttgcctgcatggagagatccttgcggaaaatattgaatcgggatagtcgatttgcgatccaaaccgtttcgggtcttttgctagtccgttgtgaggagatattcctgtttcagttcttgggagatcagcgttgctggcagattgtcttgacttcccgtactactcataaactaaaaatgggcacgacagcgaaagatttgttgtctatcaataatacgtttgttcaaataagccaagattgcattgtgaacttgacttatttgatgttcatcgagaataagaccttacgatgcgagttctatccccccttccaagaggaggagaggatcgcctcgcatcgctattttaaacaactgagagaacggctggatattatttgatggttcctcttcttttctccctaattttatctgttttgcagggtgtaataggcttctgaagtgaataactaacggcttgggaagtgaataactaatcacttgagaagccttttgcaagcgattaagtatgttgtctaaataattcattttcaccgcataaggaatttacatttcaagtcgtaaattatttacttcagtaacggatagtgcctactaagatttgcttattttctgacatttacatacaagagagtcaatatattctagccatccaatccgcgaaaaagtagtcatataccctataaaagccatcttcctgtgttatcaaatcatttttcaacagaggtttgaccgcagattgtacagaactggctgagggtagcttgtattttttgataaatgctgatgacgtgagaccttctgctctgccctctttggcgatagcttgtaaaacaagtttttgtttgggagcaagattggcaagtagatccttgtaactactttcttgtgttagaatcacattcttgcgggctatttctatcttatccatactacaacgctcaccctcttcggtcaatgcgaaaagttcgttcattatcatttgcacaaaccaagtatagccatcgaacatccgataaacttcttctattacggatttgtcgataagctttcccctttgctcaaaaagccggttggcgaactccacatagatatgaatgggtattggcttaagtcctatactaatagcgctttgataaaaaggcttggaagaggaattaaacatattactcatcaaatggcgtttactgccggagaagataaacatagtctgcttgcattgttgaatcttggttcgcaacaacgcttctacatttttctcctcatagccgccaatttgttggaactcatcgatcgccacgatacatggtttatctgcggtctctagataagcgaagatctcatcaagtgttgtttgtggtgcttgaatgtctcctagcccaatatcaaaacaaggttctccggttaccatatccagtttaaaacccgcacgcaatgaggttatgatttgaaagaaccgttccgtccaaaccgttttctttggcttcaattcgtcatagatggcttttcctaatagatatacgaactctgttaatgaagtagtggcataaatatccacaaagaacgcatgataatttttttctatcgattcttgatgaaaaagatgttggatcaatccggtcttacccaaacggcgtggagaaatcaatgcgacattacgtccgttctcaatctgtttaatcaagaagcttgtctctccctcacggtcacaaaaatatttgtctgatacatatctacccacgacaaaaggattcatcattgcgattgtctccataatataaatgcattttattgcaaatataataattatatccataataaagaaaggaaacggtatgtttcacttgcacgtgtgggagtccgtattaaataatttgatatagagtgatttaattcgattatttatatatcttcgcattgtagaaaccgccgtttcggaaacagcggtttcggaactgtgtattattgccatgcgtaaagattaatctttagtatagaaagaatggaaaaacaatcatttatcgctctagtaaagcgttattatccttggatctgcagtatggagaaggctgcttttcgtatacatgatgatgtgaatcagaaatatgatcatgtgttgccttatggatttcatctgaaaatgacggtatcgtatgtctctcgctacggatatctggtagctgagaccgaggcggatatactgattttgtatgcctctgcttttctgcatgatacgatagaagatgcacggatgacctataatgatgtcgtgaaattcctgaaagagttcaaggggggaggctttgtcttgccggaaggcgtgagacagcacttggaagaccaagttccggaaatcgtatacgccttaacgaatgaaaaaggacgaaaccggggagaacgggcgaatgacctgtattatcaaggaatacggcagactaaattcgcttcttttataaaaatgtgtgatcggctggcgaatatccaatatacgatgatgtttgtttttgcgaaccggatgttggatgtttaccgtaaagagtatccggaatttatccgatcgatcagtgaaggtgcggttacacaggtgccggatgccatgaaggaggaagcggaacgtctgttaaatagcgaatcgtatattatatagtcttctcgaatgtctttttttcagaaatccatacggagcgatgaagatctgctcacctcattgaggcaggggagcgaggatgcgtttactgttatttatgagcggtatcataaattattgtatgtgttggcctataaatatttgaaaagtacatattcttcggaagatgccgtacagcaagtttttctgaaattgtgggaggcacgttccctactgatggtgaacgtgaatttaaggaactatctctatacaatgctaaagaatcacgtattaaatgagatccggaataataatagcgccgtagagaaaaattatgagatcgtacaatcagcgccggaatatgaggatgaactgcttataaagatagaggaacaagatatgatgtctcatttttaccaagcgatcgatcacttgccggagcagaaacgccaagtctgtctgtataagctgaaagggaatctttctaatcaagaaatcgccgataagatgaatatctcggtccccacggtaaaaacacattatgcgcaagcgataaaaatactgcgggcacatttcgagagactatttttatttcttttatatttgtggaactcatcctattgatggctttgcgtgtcaattgataaaagaaaatgaatatgaaaatacccgatctatcgatcatagagaaaacgctaaataatgaggctacttccgaggagtcttgtgaggttgttcgttggtttaagaccccggaaggacaggcatggcttgctgagcgtatcgatcaggatgagaaaacgattcatatgggggaggaagaggcatggatcgaccatccgataccctcagccgtaatgtatcagaatattatgcggcaactccgccgacaaaaaatacgccgttttatagcgtatgcggctgcggtctttataccgattgctttaattataggacttttcatacgcataaactcacaagtggatttgttggcggatggtgggtatgacgaggtgtacgtacctaatggggaacgcatgcagctgctttttcaagatggaagtaaggtccatttgaattcgggaagccgtattcgttatccgaaaaaattcggtctctccgaacgtaaggtttatttggaaggagaggcttggttcgaggtcgccaagaacaagaatcggccttttatcgtggatctttcttatatggatataaaagtgttgggtactacctttgatgtgaaagcctatccggaggaagaagctatattcgtcgctttagagacaggatctatcgagttgaaatcaagatccttcaaatcttatcaattacgcccgggagaaaaagcgatttataacaaggcttccggacgttgtgaggtactccgttcccacgatgtcaagatgtattcggcatggagacgtaatgtgctcgtatttaagagcgcccctttatcggacgtaatgaaaacattggctcgaacttatgatatatcctttgacgtgaaggattctgccgctttgcgatatacgtatacgataacgaccgatagcgtcaatttgaccacggtattaaaagaattggaaaaaatcacgcctgtactattcgaggaaaaagggggcaagatagaagtccggatgaaaaaataaaaaaattagctataacgactcatccttttagatttgtcgtgtgtctatttgataggagagcaggaaacagagtgttaaccttaaaatagatatgcgtatggattcctcataaatagataacataagaacagccgaaaagctcctacccttttcggctgccggtcgtattaaaaataaatttctaataccaactattaaaatcaatacaaatatatgaaagaaaagcaagaaagccctcggcgtaggtgccttttaatattaattgagaaaataccgaatgccatgaagttaacctttctatttttagtcatatccttgctgagtttcacggctaccgcctcggctcagcgggtttctattgtgctggacaatgcgaaagtggagaaagttttagctaccatcacccaccaaaccgggttgagtgttgcgtatagcaaacaaatcgtagatttgaatcggagagtgagcgttaattttacgaatgcagaattgacaaatgtattggataaaataacggagggcacgtcattaagttatgaagttaaaaatggaaagatctacttatttgaaaaacctctagcgaatgcggtcacccagcaagccaaaaaaataacgggtgttgttgtcgattcaaaaggggaacctatcattggagcgaatgttgtggagaaaggtactacaaatggtacgataacagactttgatggtaaatttattttggaggtatcggataacgcgacacttcaattttcttatatcggctttatgccaacaactgtcgctattgcgggacagacttcattgaatgtacgtttaagggaggatacacaggctttggatgaggtcgtagttgtaggttatggaacccagaagaaagtaaatttgacaggttctgtttcttccgtgaagtttgatgaggaattggcgaaccgtccgatcactgatgcttctcaagcactttccggaaaggtttccggcgtgtggatcagccagaattcgggtaagccgggagatgatggagcgcaattgagaattcgtggctggggtacattgaataattcggacccgttggtgattattgacggagtagaaggggtattcagccaagtaaatccgagtgacatcgaaagtatcacagtcttgaaggatgcggctagtgcggctatttacggatcaaaggccgctaacggtgtcgttttggttacgacgaagatgggaaagaataatgagaaaacccaagtagagttgaactcttacgtcggaatgcagcagatcggacgtcattttgatttagtgacgaatagcgccgagcatatgactatggcgaatcaagctttggtgaatgggggagagaaccctcttttctcggaaacattgatctctaatttcgctaatggaacagatccttataaatacccgaatacggattggtatgactctctttatcggaatgctttaataacagggcataatttatccattcgcggtggatcggagaaactatcttccttcttgtctttgaactatttgagtcaggaaggtattttgatgaactctaaggcggagcggttcggtatccgggcaaatgtggagtataaagtgaattcatggttgagagttggcgctcgtttgaattatactcgtaggaattcccaagagccttttgatttgttccgtgtattcgaacagcaacaaggtgcggctcctttcatcgctccatatacccgggatggccgtttcggttcggtagaagcgattaaggatgatggtactttattgtatacgacttatcagccggttatagacgcttcgaacggggcgactaaaacatccaaggattatatggctgtaaatgctttcgctaccgtagattttacgaaagacttgaacttacaagtaacatgggcctctaatggcaattggaaaatggttgataaatataatgagaccctttatggatatacggattctggcatagagacgataccgaaaaattacaatcgtgatggtattgtgttgagtagagagcaagtatcgactatgcgtaataatttccaagcgacattaaactatagcaagcgatttgcggataagcattatgttgccgctatccttggtacccaattggagaattacagtataaagaacgtatttgcccgaagaaccaacccacccaaagaaggattaacccaagtggatgcgggaacggaaggtatcaagggagagggaaattttgaaggtctacgcatggcatcttattttggtcgattgaattatgcctttgcggataaatatttatttgagatgaatctccgtgccgatgcctcctctcgttttaaacggggaaatcgctggggtgtttttccgggtttctctgcaggatggcgtttgagtgaagaggcgtttattaagaacctgaatctgttttctaatttgaaactacgtgcgtcgtggggacaattaggcaatcaaaccattgaaggatattggccttatttaacagtgatctcccaaaattatgacttgagttataattatggaggctcattggctccgggtgctgccgtaaccgctttggtggatgaggatattacttgggaaactacctcttccttggatattggcgtggatttgggcttcttaggtaataagttgaatatagaagctgattacttcaataaaaaaacaaccgatattatcgttcaattgccaataccaaacgtattaggggataagaccgcaccgtttgagaatgtgggcgagatgaaaaataatggttttgagttagtcgtgaattatgataatcttgagacgagcagagatcgccttggatttaacgtaggactaaactttacgtatatcgataataaagtaacgaaatttcaaggaggaaactctccggaccagctttatttgattcgtgagggatatccgtataaggctttgtatggctataaagcggttggcatctatcaatcggacgaagaagccgctcaacatatgcatagcaatgggcttaagccggaaatgggaaatctgaaatacgaggatgttaataacgatggaaaattagactatcaagataaacaagtacttggtaatacgattcctaaaattacgtatggacttactgccggcttacgctataaagggtttgacttaaatatcttattccaaggtttgggacaggcgaatgcgtttacgaagagcggcatgacccgtatgcaatacgaatggctgactatttctgataaatggcgggatgcgtggagcccagagaatccggactcaaatataccgatgcttcggtttgactcttcatgggacacgtatgactcctcattttgggtacatcgtatcgatttcttgaaattgaagaacttacaattaggttatgcgttccctgaatggattacctcaaagctaaaaatgcaacggttgtatgtatatgcgaatgcccagaacctgtttacgattatgtggaaaaaagggtatgaaggatatgatccggaaagaaatacgtttgattcgggtaccaattattacccgactccgagaatatttacatttggtataaatcttaatttctaaaagtatgaaacagttattagcatattgcttatcaattatactatgtgtctctttcacgggatgtatggagaattatttggatttgtatcctgaggataagattacttcggcgagtttcccggaaaatgaatcggatatcaaactccttttaaatggtgtctatgctcaattgagggaaaaagaggtttataatcaaggcttgtttggctttggcataacggatggagctacccctaacgcatttaactggggaacggatgaggtttttaataagctgggtgccgggcgattgagctctagtgacggaggagtcgtaacgtatcgttggaaaagatgttacgagataatctcccgggcaaactatttgttggcctgtatggatttagtggatttatcggaagaagcgaaagccaaatattcaggtgagactcattttctacggggactggcttattccgtgctagcggaaacctatggtggggtacctattatattgacgaacatttccacggaagaagctcgtagcttgaagcgggcgagtttggaggagacttggcaacaggcgttggatgattatgaggttgcgatcaccaatttgggagtggatgctcccgagccggggcgtgctaccaagggggcggctttaggtatgaaaatgcgagcctacttataccaaggtaaatacaaggaggttctggcttgtgtcgagcaaattgatgcgttgaagaaatatggtctattccatagttatgagggcttgtttgatccggctaatgagaacaataaggaagtattgtttgatatccaatatattgaaggcgagaattcgcaaggttcctatattgaccagtattgcggaacgggtaccggaagttggacccgtggaagccgttatgtccctacggatgatttggtagcggcttatgagacgatcgacggctctcctgtagatcccgagaatccttatgagaaccgggatcctcgtttaggtttcacggctgtacttccgggttcttatttcttgggctatcgtttccctaattacctgtatccgggaggtgcgtttaatcatgccggtaatcggttgaaacatttaagtacccgtaaatatcggattcaggatgagtcaaagcttcctccttccgggcagtcttatatcaatgatatcatactgagatatgcggatgtcttattgtcaaaagcggaggcgattattgagacgaatggaaatgtagcggatgcgatcgctatcctcaaccggatccgtacggaaagggatgacgttaagatctctttgctgccgacatctatgagtcgtgaggaggctcgtgagaaagtaagacatgagagacggattgagttagcgttggaaggccgttattggtcagacgtgaaacgttggaaaatcgggaagacgctttatcctatgattataaaagatcatgaaggaagcgtgatcgagacgaagttcccgaatggatatctggaatattacgatttactgcctattcctgatagcgagcgctctttgaatccgaatttggatcagaacccgggttggtaatgttcaactaaaagaaggatgaaatgaaatttatatctaaattgataccggtattagccctttccggagcggccgtggctactcaagcggcggaaaggccaaatgtgataatcgtatttatcgatgatttcggatatggggatttaggttgttacgggagtacgaagcatcgtactccccatatcgaccagatggctaaagagggaatacgactgaccgatttttatgtgggttcgagcgtgagcacaccttccagatcggctttattgacagggtgttatccaaggcgagtctccatgcatgtaaatgcggaccctacacctttgatgtccaaagggaggcaagtgctatttccagcttcgcataaaggcttgaatcccggtgagataacgatcgccgagttgatgaaggagcaggggtatgcgacggcttgtatcgggaaatggcatctaggggatcaattgccatttcttcctacccggcagggtttcgactattattatggtattccttatagtaacgatatggatcgtccgtattgtccgttacccttgatggaacaggaggaggtaatagtggctccagtcggtcatgattccttgacgattcgttatactaataagactgtggagtttataaagtctcataaggaatctccgttctttatttatttgtgccataatatgactcataatccgttagcggcttctcccgctttcaagggaaagtctcagaacggactctatggggatgcgaccgaggaattggattggtcgatgggagtcttgcttgagactttaaaggaggaaggattggatcaaaataccttggttatctttacttccgataatggtgcggatgaacacttcggcggtacgaaccgtccgttgagaggccaaaagggtacgacgtatgaaggtgggttcagggtgccttgtataatgagatggcccgctaaaataccggcgggacaggagactgataatctggtgacttcgatggatttcttaccgacattggcgcattattgcggttatgcggttccttccgaccgggtgatagatgggcataatgtgtctggaatcttggagggagaatcgatggcatcgcccacggagactttctattattaccagaaacaacaattacaggcggtacgttggggaaactggaagtatcatttacctttgaaggaacgtatcaaaggccctcacttcccggatacggaagtcggtgaagctcgtttatataatttggcgaatgatttgtcggaaacaaccaatgtcatcgataaacatcccgaagtagtgacgaagatgaatcaatggatcgaacaggttcgtagtgatatgggagattggggatgtgaaggccggaaccagcgtcctgccggtatcatagatgaaccttttccccgtttacttaaataaaaagatacgtatatgaaaacactgaaatcattgtctgttttaacagcggcggtattatcgaacagcttgagcttgaacgctgcctcggatgcggccaataagcctaattttgtaatcatattctgtgacgatatgggatatggggatttgagttgctatgggaatcccacgatccgcacaccgaatatagaccgtatggcttgtgaaggaatgaagctgacccagttttatgtgggggccggagtttctacaccaagtcgggccgcgttaatgaccggacgtttgccggttcgaaatggattgtatggagatcgggtagccgtacttttccctaactcaaaggctgggttaggacaagatgaggtcacgatcgccaaagttttacaacaaaacgggtatgcgaccggctgtgtaggcaaatggcatttaggtgcgttttctccctatttaccgacggatcatggttttgatacctatttcggcataccttattccaatgatatgagccctgttcagaataaaggcgcgcatgcccggaattttccatcgactccattgatattggatggtaagcaaatcgaatcggaaccggatcagggagaattaacccgtcgctatacggagaaagcggtatcgttcatcaaggatcattcaaaggaacctttcttcctttatttcgctcataccttcccgcatatcccattgtacacgaatgcccgtttcgagggaacgagcaaacgaggcctgtacggagatgtggttgaggaaatagactggagcgttggggaggtgttgaaggctctgcgtgaaaatggcttggacgagaatacgtttgttatttttaccagcgataacggcccttggctgacggagcatgagaatggtggttccgcaggtccgttgaaggatggcaagggtacttggtgggaaggtggcttccgggttccggccatttgttggatgccgggaaaaatcaatccggcgatcaacgatgagattatgacctcgatggatttatatccgactttcctctcgatggcgggtatcgagcaaccgaaagatcttgtattggatggcgtgaatcaaaccggattattgtttgaggaaaagcattccgcccgtgatgaagtttattattggtggggaagcgagttgatggcgatccgtaaaggggagtggaagtattattttaagacgatcaaggaccaatatctgcgaacctgtaagatcgagactccggcagaacccttgttgtataacgtggagacagatatctcggagaggttcaatcaggcggagaagcatccggagatcgtgaaattactgatcgaggccggtgagaaacataagaaaggaatgaagatcaagccttccgtatgtgatatgatgtaatgggacatttaaaaacactagattagatgaataaatatatactaacagcggcttgcggattggctttttccgcagcttccgcacaaacaaaggctttgccggatagcccgaatatcctgctgattttggtggatgatttgggatatggcgatttgtcctgtcaaggagccgccaaggacattcaaactccacatatcgataaattattaaatgaaggagttcgtttcacgaatttccatgcgaactgtccggtctcctctcctagtagagcctcgttattaaccggtcgttatccggatatggtaggcgtaccgggagttattcgtacgcataaagaggatagctgggggtatctgtcggaggatgccgtattattaccccagatgttgaagaaaagaggctatcataatgcgatggttggaaaatggaatctaggattggagtctccgaatacccctacggaaaggggcttcgatttctaccggggatttttaggggatatgatggatgattattatacccatcgtcgtttcggaaataattatatgcgtgagaacttgaaagagatcgatccacaaggacatgctacagagattttctctgattgggcgatccgttacctgtcggatatgaagcaaaagcaagagcctttcttcttgtatctagcttataatgccccacataccccgatacaacctcctcaggaatggctggaaaaggtgaaaaagcgtgaaccgtcacttcctgagaagcgtgctaagattgtcgccttgattgagcatttggattataacgtcggacgtgtgtatgaggccttggaacagaatggccagttggagaatacgatcattatatttacctctgataatggagggcaggacgatgcgggtgcgaataacggcccgttcagaggcgcgaagcaggatatgtatgagggagggatccgggtagccggaggtatttattggaagaaccagatccgtccggcggtacgtgataatttcgtcatgctttcggatatgttcccgaccttatgcgatctgacagccgtgcctgtatcacatgagatcgacggtatcagtatcttgcctcttttacggggtgaggaacaagataccggagatcgaatggtgcattgggtgcgaagggaaggtaattcccgatatggaggtcaggcatattacgcatctcaataccgggatttcaagattttacaaaatactccttgggagcctatccaattctttaatataaaggaagatccgaaggaacaaagtccgatcggggaacgatcttcagatacgtataaaaacttgttcaatggcttgatggagcatatccgtcagacgggtatggtaccgtggcaaggcaaacggtataagtgattttcccatgtgattttttagaagcacgtacatcgttattcatggtggtgtacgtgcttttttgtaattttttattgctcttaactgaatttgaatgtttttttgtatgtttgcgccaaatctgtgggagttattgtatacatgatctatatggaaatatccgatgagaagctatgggaatcgtgtctgaagggagataaggaagctttccgtgagctttattgccgattttacgcattgctgcgcaattatggaatcaagttacttcccgacaagaacttggtggaagattgcgtacaggatatttttatcaatttgattcaaaaccatacttccctctctccgacggcgaatgtcagaggatatctgcttaaggctttaagacataagctgtatgatacgatcgagaaaaacaggaaaatggaggatgtctccttatatgaggacgtgtttcaagtggatgagttattctcccgtatcgcattggatacgacagatacggacgatcgggttaaacttttgatgaaagccttgacaaaactttctccccatcagcgagagatcatttatctttattatgtaaatgaattggggcataatgagatagctagtattttaggcataaattaccaatccagtaaaaatttattgtctagaacactccgtaagttaaggcggtggttctcgttggagctttaatgtattcttggactctttttatgtcgcagtatatcaaagatatattgtgccaataattttcgccttgatggcacagtcgtgccatccaagtggcaaagctgtgccatcggtgtggcatagttgtgccatcaaggtggcacagccgtgccctagggatggcaaaagaggttgtaagaatgaaaaaaatggcggattcgctatttttcccggtaaaaagtgagtaccaaaacgaattccatccgtaataagagtaaacaggtatctcgtgaataagaaacaggacatggttgagaaggattcatttcggcaagccggagaagatttgttgcgtaaagttcgtgaagaggagcgagcggatttgcgactggcactttcttcttggcagaagttggaggaacgtttgaatgctccccgtaagacctctgttttacgtatacgctatcttgtttcttccgtagcggccgccgtcatgttgcttcttgccgtgggatgttatttttggatgatgggacatgataaatcttcattgcctttggccttgttggaggaaaagaatgttggcgccttgccgggggatgagattgtcttggtgaaggatcaaggttgggttcaactgaaagatgaagctacggtaatttatgatacggtaggcaaatcaaatgtagaggaacaccaaatagaaaagaatgagcaagaaactaaaattgatgagccggatcaaataatagtaccgaaaggacggcgtgcgaatatcgtattttcagatggtactaaaatgtatatcaatgcagagacccgggtgatttttcctacggtttttgctaaagataagcgggagatattagtggatggagaggtctatttggaagttgctgcggacccttctcgcccttttattgttaaaacgagtacgatcgaggtaaaagtgcttggcactcgattcaatgtgtgtgcttatcgggatgaacctgcggcttccgttgtattagtggaaggacaggtcgaggtgaaaaatggcgataatggtaagaatgtgctgagccctgatgatatgcttgagttaaagggtaaagagatatcgatcaaaaaggtagatgtctttgaacatatttgttggaaagataacttgatgctgttaaatgatcgtaaggttggagaggtcttaaatcggttgtctcgttattatggccggactattttatttggcaaagagataggtgaaatacctatttcaggaaaattggagctgagagagaacttggaggaagttgttgagattatttgtcaatctctttttctacgccaagagagagacggggagaataatataattttattaaaataatttgcctatgggaaaggaatgatctgtaagcgtgtttgcatttacaagagagccagaagatactgccatatcttccggctcaggagctttgtttaatcaataattacgtactaaagaaaaaacattacaaaggtatgaagaaaaaagaagatttctgccgagaatcaaatcattttctcaaaagtcttggtttagccttatgtctggtaagttttggaggatctgcgatatatgcgtcttccctatatgcgcagcggactatgctaagcattcaaatgaatgatcgtacggtagaagatgtatttgaatacattgagaaaaacagtgagtttatttttgtgtatcatggttctaacattgatttgcataggaaagttaatctggatattcgggatcagtctgtagagataatattagataaattattcagcggaacggatattgagtatattattaataatcgtcaaataatcgtacgccgagacacgaaaaaagaggatttaccgattgctagtcaacagacgaaaaaggtaaaaataacaggtgtcgtgaaagatgctcacggggatcccgtgattggtgcgaatgtagtagaaaaaggaacgactaacggcactattagtgatctggacggaaacttttccttggatgtttccgctgggaatgtgctaatggtatcttatgtcggttttcaagaaaaagaggttcctgttggggataaaaaagttctccaaatagtgcttgatgaagattcaaaagccttggaggaagttgtcgttaccgctttgggtattactcgttcagagaaagcgttaggttatgctactcaaaagttcaagggggatgaattggagaaagttaagggcgtgaatatcgcgacgagtttaagtggtaggatctcgggcatgcgagtgtataattctacggaatttggggtcgctcctaagataaaattacgtggagaggagcctttggttgtcgtagatggcgttcctacaaatcaagcgtttagtgatttcaaccaggatgtgattgagaacatcactgtgttgaaaggggctacggcctctgcgttgtatggttcccgaggtggtaatggagcgatcatgattaccaccaagaaagggggtgataagggcttttctatagaggtaaataccagtaatatgtttaatgccggacagttaaaaataccggaggtgcagacggcttatagcgccgggtctggaggtaaatttgataatatagattatgtctggggcgataagttggatattggtcgtgtttatacgcaatgggatcctattaagaaagagtatcgggaaatggagttgacttcgaggggtaagaataattttaagaatttcttggagtttagtatgatcagtaatactacggtcagtgtatcatcttctggtaagaatggaagcatccgcacttctttgtcttatttgtatgataagaatcaatatccgaattcacgtaagaataaattctggtataatattggtggagagctgaaactaggcaataaggcgagcgtggaaggtagtatgaactttacgcaggaatctgcgccgaatacggctgggtatggatatggtaccggatatatgtacaatattttattatggacaggtccggagtatgatctgcgggattacaaggattattggcttgtcccaaatgaaaagcagaattggcattatacggattggtatgataatccttattttgaggcttatgagaagattaagtcgataaataattttacgacgaatggttcattgtcttttaagtacgagatactcccttggatgaaattgcaattgcgtgcgggaggagtcgcttatgcgaataacaatgtgactcgttcttcggtgggaacgatctctaaaggccgtggtggctgggaagacggagcgctgggttattataaagagggcaagaagactggttttaccatgaattatgatttcttcttgctgtttaacaagaagctgagtgattttagtgttgacggtttattgggaggttctctttattatacgaaaacaaagaatctggaagcttccacgaagaatggcttgtctgttcccggtttttattcgataaaagcttccgtagaaagtccgatcgtggatgcggagactaagacgaaaaaagtgaatagtctgttcggtacgttgacattggggtataaggatacttattatctggaggctacagggcgtaatgactggtcttctactttgccttcaaatgataaatcatatttttatccttccgtgggagtgagtattattccttctaatataataagcttgccggattggatacccttctggaaattgagaggatcgtggacagtctctaaaactgatttagctatttatgatttagatcgggcctatacgattaaacagaatgtttgggatggcttgaatacggctagttatccggattatttgcgtggcgacgtgaagcctatcacgaatcgtacatgggaaataggtacgggtattcatttcttgcaaggacatcgcttgaaattagatgtgagttatttcaataagttgacttataataatacgatcagccaaaggatatcttccgctacgggatataaatcgagattgatgaatattgacgaagaatatgttcgtcggggagtggagatttctattgacgctactccggtacaagtccgtgatttctcatgggatgtgtcgttgaatctttcgacgagcaagaggtattacgctaaattggatgagagcttcagcccggataacttgtggacatacgtgggcgctcgtacggattcttattcatataaaggctatgacaaagatccggatggtaattatattattaatacgaatggcttgatgtctaggagccaatatagctctttgattggttatacggatccggatttagagtatggtctagcgaatgtattcaagtataagaactttacgctgacactcaattttgatggccgtattggtggaaaatcatggtcgaatacggaattccacatgttggaaaccggcgctcatccggatacggacaatcaatggagatatgatgaggtggtgaatggcaagaaaaattatgtgggtgaaggtgtcaagattgtatcaggcgaggtcaaatatgatcaatatggcaggattacatcagatacgcgggtattcgctccgaatgatatcgagacttcttatgaggattttgtaagaagcagccataataatccagataaattagttcagaaaaagacgttcttgaaattgagggaaatgtcaatcggatataatttgccgacgaagtttattagtaagttaagtatgaatagctgttatgtaggctttatcggacagaatttatttgtgttgaccaaagattttagattctcggatccggatggctttgaggatattgagggcgaggatatatcttctccgtctataaggtatgtaggtgtaaacttgaaagttgaattttaaaagctaaacgtatgaaaattaaaaatatattgatatgcggactggttttgttgggtatggttggatgtgatgatttcgaaagcgtaaatacaaatcccgactcaactaacaaagtaacatctgcgatgttggcaacagaactgttacgtgatattaccacttataaaaatgggaatggaaaggattttatccgggatgaattgttagctaagtatttgtcgtggacagaggctaatgatatagatctggcattcaatttgttgggtggagcaaattatgatgctttgagagatttgcggaatgcctcgaagatgattgattttgcgacgaatgatgagttgaaaaactcctatacggcattgtctcatttcgtacgggttttctttttcttcaatttgacaatgcaagtgggggacataccttattctgaagctttaagagctgaggatgaagaggtgtatttcccgaaatatgactctcaaaaagatgtttttctcgggttattgaatgaattggatgaggcggaccgtctctttagtgctggtactaattttgagggtgattatatttatggaggggatgtgacgaaatggcgtaaggctgtgaatgttatgcaattgaagttgcttcttaatttgtataaaaaggtcgatgatccggatttaaaggttcgggaaagaatcaatgagattatcaataacagacctgtttttgagtcgattgcggataatttccaagttgtgtactctaataaggctggacagaaatatccttattttaaggaaattaatagttttgtgaataatgacaggatgactgatctttttgttgataaattgaaagccttgaaagattatcgtttattttattatgcgaaaccgacaccgagctcagaagaagccaagttggatccctcggaatgggatgcttatggtggagtagacccgaccttaccggagtctgagatcttgacttttgtgagtgggggaactgtttctcaaataaatgatcgctacgaggaactgccggagggcgagcctgtatttttcttgagttatcaagaacaaaattttatactggctgagatggctctgagaggttttatctcaaaaagtcccaatgagtattatgaggaaggcgttcgttcttcaatgcggtttgtggcggataatacccccgatgatgttatgttccatcataatcgaaaaataacagatgcctatattcaagaatatctcggaaaccaaggcgttaagttcgctagtgattttcaagaacagttgagtcagattatttggcaaaagtacatattgacctttcttcaaacaccttacaatgctttctttgaatatcgtaggacaggtgtaccgaatattccgataaatccgaaatcgaataggaatataccttctgataaaatgccgttaagatggatgtatccatcggaagagttggattacaatatggataatgtctcaaaatcaattagcgaccagtatggagggtcggatgactatatgggtgtcatgtggattttgaaatgagaatgtcatgcatataattttccgggtcatttcaaaggaaaaaagagctctttttttgttatttctataaagatatttacctttgtctctatgttaaggataataacacatattgaacgcttattgctgacgcatgattgtgtgatcttgccgaagtttggtggtttcgtgctgcaaatcttgccggcgacgtatgaggaagaggaacattcgtttcggccgatgcgtaaagaggttatgttcaatgtaacgctacagcatacagacggcttgctttccgagtcgtatatgcagacgtatggcgttgattaccggaaagctcaattgatgttggaagaggatatcgaggctttgaatgtttctttggaacaagacaagcggataacattggggcgaatcgggactttctctataggagaggaagggcagaccatttttacgccgggcgattctggggtatttaatgcggattcgtatggtttatcatcgtttcattttccggttttgcgatcgttggaggaagagcgggaagaggttgccttacttactggtaagaaaaagaaagatgtgttctatatcccggttagtcgtaagttgatccggggtgttgcggcgtcagctgctgctgtcgcattattctttgtggtttcgactccggtgaaagaagtaaacctgtccgcttatacagctagttttgttcctacggagatgataaattataggtttgaggaaccgatttctcagctggaggaaattcaagtatcccaagaggacgagatggtagcggaggtaactcccaaaatagaagcaactaaggagacagagattgccaaagcggcttctgctcctgaggtaaagaaagagcttgttgctcccgctccgaaagtgaaatccgtggcaccgaagaagatgtatcatatcgtgatagcgagtttcccgacagaggagcaggcgaatgagtatatatccggtgtagaccgtgcgcaatgtaaaaatgtaagcaaggtggttcgtgatggtaaatatcgtatttatgcggataagtttaataaccgggcggatgccgagagctacatggcgacacttcgaaaaatagaaaagtataaagatgcttggctgttcattagccgttaataaaaaagcctgatcgaaagatcaggctttttttatgacttgtcgtcgttttgtggccggggcagtcttttcttcttcaaccgtcctgcctttcgtaaggcttggtccagaatgtactggatttggccattggtgctgcgaaattcgtccgcagcccaagcttcgatagcttccatcatatcagcgtccacccgcaggatgaagcttttgacagtattatcttttttggccatatactagtattaatattaaattcttacattaatgatgtagagtcccggtatttacgacaggttgcgctgcctcgtcagcacaaaggacaaccaacagattactgaccattgcggcctttcgttcctcatccagttccacaatattgtctttatccagtttgttcaaggcgagttgaaccatgctaaccgctccttccacgatccgttctctggcggcgataattgcttccgcttgctggcggcgtaacatgactccggcgatctcggaagcatacgctaagtaattgatacgggcttccaatacctcaatgcctgctatcgccaaacggctgtttaattcctcctccagtttttgagcgacctccccgtcatcggatcgtaaggtgacgggatctttgctctcgttataatcataggcatacatgccagctatcttacggatggcggcgtcactttgtatctgcacgaaattctcataattctgcattcgttgggataattcagaggattctcccagtgatatgaatgatttattcgaggagatactaatggacgaagaatcgatgtcgaacatcgctttataagtatccttgactttccataccatcacggccccgatcataaccggattgccgaccttatcgttaaccttgataggagggacatctaagttacgggcacgtaacgtgattttctttttgctgtaaagtggattgacccagaaaaatccgttatcagtaattgtccctttatattttccgaaaaagagcattactcgggcattgttgggctcgatttccatgaatcccaataaacaaaccactaacaggcagagtccgacgatgccggtgattacgctccaagtctcatttatgcctgcgattaaatagcagctaagacccgatagagccagtatgagaaaaagggcaagaaacccagagattctcagtccgttgaatgtcttttcagttgctttcatgatgatttatatttgatattaatttgatatcacaaaataagtgatttttatggagactgccaaatattttgagggatattattagagtgatctgtaaatattttcatagctttgtctcatctaaaaattacatgcttggactttcagttagacacgaacaataaggagtttcaggatgccttgcaactgatcactcacactcgccagtccgttttccttacagggaaagccgggacaggcaagtctacctttttgaagtatatctgtaatcatacgaagaaaaagtatgtggtgctggctcctaccggaatcgcagccataaatgcaggtggcgttaccttgcattcttttttcaagcttcctttccggccgatgttgccggatgatccggatttaagtttgtcgcatggtcgtatctttgagtttttcaagtatccgaaggagaaacggaagattatagcggaggtcgatttgattatcattgatgagatatcgatggtgagggcggatattattgattgtgtagatcgtatcttgagagtttactccggcaatatgcgattacctttcggtggaaagcagttattgtttgtaggagatgtcttccagttggagccggttgttccgtcggatcaaaaagagatcttaagtttgttctatgcgagccctttctttttctcggctcgtgtgttcaaggatatcaatttagtaccgatcgagttgcaaaaggtgtatcgccagaccgatcctgtttttatcaatgtattggatcggattcgtaataatgccgctagaaaacaggagttggatacgttgaacggtcgttattttccgtctttcgaaccgcaaaatgaggatatgtatattacgctggccactcgccgggatcaggttgattttatcaatgagaagaagttggccgaacttcccggagaagaatatgtctccgtgggaaagatcgagggggattttccggaatcctcattacctacccagctgaatttatccatcaaggaacaggcgcaggttatttttatcgataatgattatgagcgtcgttgggtaaacggaacgattggtatggtatcgggtatcgatgagaatggaaatgtttatgtcttgctggagagcggtgtggaacatttggtggaacctacctcatggcgaaattataaatacaaatataacgagaaagagagacggatcgaggaggagattgtcggtacgttcgaacaattgccgattcgtttggcttgggcgatcacggtgcataagagtcaaggcttgacttttagccgggtggtagttgatttgaccgggggtgtattcgccgggggacaaacctatgtggcgttgagccgttgtacctcattggagggattggtgctaaaaagcaagatctcttcccgggatatctttatccggaaagagatcgtggaattcagccaaatattcaacaaccaagcgttaatagagaaaagcctcaaggaaagtgaggcggaactacaatatggtcgggcggctcagggatttcggctaggtaatatgcaagaggcggtcgaggcttttgccgccgctgtatctaaacggaatgaattggataatccgatggtacaacggctgcttcgtttgaaattgcaagcgttgaatagtcaaaaggcacagattaaggctttgcgggaagagttgcattcgcttcgtgagacccagaaagagtatgcgcatgaatattacttgatgggcaacgagtgcataacgaaggcccatgacgcgaatgccgctatccgttgttttgataaggccttgaatttgaatccgaattatgtggaagcttgggtacgcaaaggggttactttattggatataggtgaggactatgacgctcaggtttgtttaaacaaggcggtaaaattaagcccgaagtcttttaaggctcgctataaccgtggaaaatgcctattgaaactcaaatattacgatgaagctattctggatttccagcaggcgataagcatcaaacctaaacatgcggcttcccacgaatatctagcggaagggttccgggcgataggagaggacgaattagcccagcagcatcaagatattgcggatgccttgcgagggggagaggatatatgatgaaatagaaaaggcgagaaaatttatttcccgccttttttatggagttatatctcttgattaattaaagatgtaacggataccaacctgcattttccagcattcagtatagatacggttataagaataagtctcagtcggatattcaccattgatcttatacatggagaaaattggagtcttgttatcatccatgccttcatatttcaagatacggcaaccgttggaagaagatgcgttcttcattacaccccatttcgagttgatcatattaccgatattcatgaaatcaaggctcaattggaaatgatgttcggttttacctgccttgaatgagaaatcttccgtaatacgaaggtcgaaacgatgtacccaaggtgcacgtgcggcataagcctcagcgtattctcccttgtgattctttaaataagaatcttggtctacgaagttccagaaagcggttctatctgcttcattcttgaatttgatttcactgtcatctttcgggatatacatcatatcattattgataccgtcgccattcatatcattcgtataagcgaagctatatccggaagcggaataaccggaatagaacagatttaagcttgtttttctgagcagacctttatggcggaagggtagattataattgatcgctgcgattaccttgtcgggcactacataccgtgaacgttgtacggttgcgaaattcggtccgtctatcgttaacattccctgccatgtagatacagggtcgctacccggaagaccggaaatttctttggattccgtgtgcgtataagccaacatcatgttcaaatcctctacgggttgagcgttaaccgtaacattggcggtataaccatgtcctttggatgtgttagttaatacaaccgcattcttaccggatacatacgtataatcagatggataaatcaaacggttatccgctccgttaaaatgttcccaatttgacgggtccttgatgttgatattctcaagggttacggcattgatgttcttgttatagatgaactcgccggttacggataatgggaaggaagtagggagctgataatctacagccaaggaggttttccatatttgtggcatcttgaagttgtcctttacgccagagatcttagaaccggcaaccggattctctatcgtggtaggaaggccgaatttcttgatcgcatcgtctacattcgtaatcatgccgccagccaattgatccagacgggaatcatgacttaccgcaattccattctcatattttgtaccgaatactacggcattttgtaccatattcgagtttgtcggcatattcgtaaagaataccaagggtaaacgtccggtaaatatacctgtaccaccacgtacttttaaggaattatccttgaacacatcccaaacgaaacctacacgaggggatatttgcattctagacttaggccatttgccggtgtcgatatgtttgcctccgaaatcaagatcgtagattgcgtcgtttctttgaagatcactattgtcgaaaattaaatcatcgaaacgtataccataagttaacttcacgttcggacgaatgttccactcatcctgtgcgtagaatccgatctggttaaaagtaacctgagctttcgggtcggaaacaccgttgtaaccgtatgtccatgcgaacgtttcaggagcggcaccgttcaagaaatcatctaagctgctgtaacgataatatcccgtaccgttgcgcatataagcattgctagcaagttggtgctcgaaactgataccagctgtgatcttatggtcgccggcaaagtaagtgaagttatcgataatacttgtgatcttgttcttcacgccgttgttgtaagtaaataattcatatccggcactcatataaggctccatgatttggttaccttccgcatctttacctgccaagatatcaatgaagggaaaaggggaagagttggttccgcgcatatcctcgatatccgtataagtgaaaagtaactgattggaaatcttatcagagaagcgactgttcaaatcagcggatacggaagacactttattgtcttgggaatacatgctgttggcaaaagacatggattggtaacctacacggcttgtattatacagacgagagccggaaccaccatccatagagttagcgttgggagcgttccatgcggtattctttgtatagttgtaccgtacgctcaatttatggccattcgtgatattccagtcgatacgacctaacaatttcaaattcttttcgtctgcggggaagttcgtggctgatcctgtatcataaccatatttatctcttaagaaatcggataccttttgcatgtcggagagtgtagtgcgagatatgtagttattctcgtccggttgctctccttcggtacgagctctccatttgatcacttgttgcggttgtttttccacctctacattggcgaagaagaataatttattcttgatgatcggaccgccgaacgtagctccgtaaatcgttttggattccttagcacgtgcgcccaagtcttctccatcgattgagtttcctcgcatattctggttctggaagtaagtgtaagcggaacctttgaatgtgtttgtaccggatttggtgatagcgttgataccgccaccaatgaagtttgtctggcggacatcgaacggggcgattaccacttgtacttcctcgatagcgtccatagagatcgggttaccgcctccgggaagattatccgaaaggccgaagttgttattaaagttcgctccatctaccgtaaagttcgtggaacggccatcgccaccggcaaaactcatgtcggaggcataaggagaaaggcgtgcgatatcggagatactacggttaatggtgggtaaagaggtgatctgtgacgaggagatattggttgtcgcacccgtcttttccgtattgaacttcgttttcgccgctgtgattacgatctcgtccaaggtctcagaagattctttcaacttaacattcaagttgtagttctctcccaattgcagggtaatgccggaataaacggcagattgataaccaacgtaagagatcgtaactttgtatggacctcctgtacgcataccttgtaaggaaaagcgtccgtcaacgtttgtgatcgtaccataatttgtcccagaaggttcgtgaaccgccaaaacggtcgcaccaataacgggttcatcttgaaacataactgttccactcatactggctgttgttacctgtgcttgtgtcgggatgacaaacaagaaactcagtacagctaaaaggaatagcgtctgtaaatgtctgctcataatttaaaatagttaatgtaataaaaactttcgcaaagttatgggttattttttaatatcattgtatgtttcttatttaatacttgtttcatattcatgaagttgctgtgacggggcggaattgagtaatgtccttattcggagatggatggcttgtattggcaaaacaagagggttctttatgaaatttttaatttgatgattcttaactaacattccctgttgggcggtgatttaaaagaattatagacgcttttcctgcatattgttggattatggatgtgattggttgagaataataatctggagatctgtgtgaggaatgttaatgctatgaatattatatatagtttgtgacaaaaagagatatctaatccctatctttgcggcgatatacaaaaatgttataattattttaaatataaatacttcttgtatgaggaaaacttatctacttttaacgttacttttgttgtgcgtgggaatatccatacatgctcaggtgacgacggcgagtatgagtggtaaagtcacggatacatcatcggaagcgatgatcggagtgaatatcaaggctacgcatacgccaacgggtaccgaatactacacgattacccagccgaatggttcttattcttttaacaaccttcgtatcggaggcccttatgtggtagagttctcttatattggatacaatacggagagccggacaggaataaacttggttttgggtgaggatctgaaactgaatgtagtaatgcgggaagatacccaagctctcgatgaggtagtcgtggttgcggataagaaccccattatttcaggaagccgtacaggtgcgcaggaaatcatcactcgtgagaagatggataagctgcctacgattaaccgttctttggatgatttcgtgaaattaaccccgatgagtagcggaaagaattttggcggtgtctcttaccgttttaataatgtaacggtggacggtgcctcctttaataactcgtttggtctggcttctgctcttggagcttccggtacggaaccgatttctttggaggcactcgagcaggtacaggtgatgatcgctccttttgatgttcgaaatggaggattcacgggtgcgggtattaactccgtaacgaaatccggttcgaatgagtttcatgcttctgtatatatgtacacgaagagtccgtctatgatgggatatcgtgtgaaggatgagacgattggtgtttcagagttctctaatcaccaatacggtatcagtttatccggtccgatcattaagaataagttattcttcttcatcaatggtgagatggatcgtcaggaggaaccgatttcttatacgaccgctaattctgcggcggatgcgacagtcttgcagggtttatctgatttcttaggtgatgagcttgggtataatccgggtaaattcgacgtgaataagacaaatactcaagcggatcgaatcacggctcgtttagactggaatatcaactcaaataatgtgttgagcttaaaatattattatttgaaatcgtttaatacgaataacccttctacttccggtgcgccgaataacggacgtggaccgaatgcgttcgctattccgttctcttcttctttctaccggacgaataataacttcaatatttggatggccgacttgaatacgaccattaatgaccgtatgtctaattatttgaagatcggttattcccgtttgcgtgattatcgcgatatggatggtggttacttcccgcaagtggatatcttggatggtgataacaatgcttatacgactttcggaaccgaggcaaactcctataataaccagttgaacagtgatatctggcagatacaggataacttcttgatgaattttggcaaacatcagattacggttggaacgcaaagtgactatcgcgcctttaagaatggtttcgctcaaaactatccgggttcttgggtatttaactctgtcgatgatttcaagttcaacgtattggctacaaaacaatacatggccgctcataacggaagtgtacaaggatttgatatccgtgagtttaatccgaaagattttggatttggttccaatgtgacaggtattacgaattcttcttctacggggtaccagtactatgcgcaaagatattcgatgacggatgattttccattcgccgagataaatgtattccagttaggtttgtatgcccaagataagtggacggtaagtgataaattgaacttgacgttaggtttacgtattgatgttccgttctttatgactgatttgcagtcgaatgataaagtcgccgccgagacctatcgggatggcatcaagatcgatgtttctaaatatccgaacgccaaacctcagttctctcctcgatttggttttaactacaaaccgtttgacgatgagaatggaagtttgcagatccgtggtggtacgggactcttcacgggtactcctccttatgtatggatcagtaatcaagccggcaacaatggcgttttgtttggtgacttgaatgtccgggcggtaaaggacaagaatgacaatatcattagcgatggcagaccttcgctaggttttaccggaaatatggatacttataaaccggctgaaggtagcgctacccgttcggatatagcgattacggatccggactttaaatatccgagcttatggaaaagtaatatcgctgccgattataagtttggtgatggctgggtagctaccgtagagttgctgtactcaaaagacattaacgctatttatcatgacaatatcggattgtatcggaccgagcaatttgtaaatgacggtggagcgggtaacgcacgtccatattataatggctattatagcgatagggaaggaaatcaaaaggccgcgaatcatgtcgtgatgctgcgtaataccagcaaaggacattcgctttatacgaccttccagttgcagaaaaactttgttgatggaatcttgaagggattgtatttgaatggatcttactctttcgggcagtctagaggtgtaacagacggaacatcgtctgtggcgacttccgcttggaagtaccgtgcggccttggacggaaatgcggaagaagtaggttatacggcaggttcttttgatggtcgtttgttattgtccgcttcttatacggctaactggagtaaatatgcggcaacaagttttggtttgatctatcagcgttatcgtccgttccgttattcttattgttataatggtgacgcgaatggcgattctcagttctccaacgacttgatgtatatccctgcgaactttgacgaggtaaaagatcatttgttaccgggcgatttcgatagccaagaagatgcatggaaagcgatgaatgcctttatcgagcaagatccttatttgagcaagcatagaggtgagtatgccgaacgtaacggtgctgtcgctccgttcgcaaatcaattggatttgagcgtttctcatgatataaagatttaccagaagaatggtcgctcacataccttgcgctttagtttcaatatcgccaacttcttgaatttgttgaatcgtaactggggtgtggtacaaacaaccgttttgggtaatcagcaatatcagttcttgacgatcccgaaaggacaaggcccgagtgcggcgaacaactatacgttgaagtatacgatggcgaaagatttggatgagaccttcaaggataatttgaacgatgtgtctcgttggcagatgcaattcggtatcaagtatatcttctaaaagaaaaatctttcattagataaaatttaataattagaggaggttcactatctttgtggacctcttttttaatttaatgatatgtggaataatcgtattgagttcttactcgttagtttcttttgtatttgttcattggcttttaccggttgccaaacgaaaaaacgatcggatcgttatgtcgtagttttatcaatggacggtttccgctctgattatccctcacgtgctcatactccgacgttggattctttggcgaatgtaggggttcgctccacgtttcgcccatgttatcccagcgtgactttcccgaatcattatagcatggctaccggattgcatccggatcaccatggtttggtaaataatttcttttatgacgcggagcttgatagttcataccggatgggaaacctggatccgcgattttatggtggagaacctatttggaatacggcggaacgccaaggggttcgtaccgcttccttctattgggtcggtagcgaggtgcctttggcgagtggccagccttcaatatggaagccgtttgataaatcggtttctttttcagatcgtgctgattccgtgatctcttggctgaagttgccggaagatatacgtcctcatttgattatgtggtatatggaagagccggatgcgataggtcattccgctaccccggattcctcggcaaccttggatgtggtagagaacttggataaagtcttgaatcatttcttcacggaagcccgtaagctggatattttcgataagatcgattttatcgttctctcggatcatggaatggccacctattatcccgagagatatgtgaacttgaatgattatctaccccgggatagtttcgattatgtctttgatggtgttcctacattattatatccgaagaaaacctatgtggatactgcctatgcgattttacagaaagtgccgaatataaccgtatggaagaaaaacgagatccctgagaaattggtttacggaaagaatcctcgagttagtgatctggttgtttctccacatattggaacgtatgtgcaattccgcgagaaatcatctccccgttatgcggcgacacatggttacgataattttacaccggagatggaggctatattctatgcggcaggtccctcgttcaagaaacacgtagaggttccgcaaatggcgaacgtgaacctctatttgatgatcgcacgcttattgaatatacagcccgccccgaatgatggagatagcgctgtcgttcagcggttatttaaatgataggacttcgcgctactttctaaatggagatttactgcacgggccttgcagtactactgtaaagccggttgcagtaattgatgccttattgatgttcgcatgtcatcttacgcatgaaagcgagactgcctttagctagctcatctgcgttgtatttagatggacgccaaagagatacgacttccgccatgccgggaacggaattggagaaattctccagaactaagttcccattgaaatcgatttcctgtagtccccggaacaaatcatcccagcgtacgtttccctcacctagcattccccggtcgctttcagtcatgtgaatatggcgaagtcggctgcctgcggcgataaccggttcatagaaactagtctcttctatattcatatggaaagtatccagatgcaaagataaattcggagcgtctatgcgtttgataaagcgcaagacttcctccgcggaggtacacatatagctttcatagcgattgatcggctctataccgatcgtgattccggatcggccggcgtattcggcaacctccgcccatacctcacaaagcgtattctcttcttcccgtgttcgctgtttgccggagaagaccccgatgccggaatgtaagacacctcccaagtaatcaacctccagttcgctcgctttatccagcgccgccttgatcaggcgagtcgcttccttgggataaaaaggaatatgcgcttcttggggaaggttgagagaacaagtcgccttcaatccgtgttgtttcaattgtcgctttacggttggagcgtcgaactccatggaaggaggcaataagatttccagtaaatcaaaaccggcgacagatgcttgctggatggcgaaaagaccgccttctggtgtccacataggtggtatccaagaaaggatggaagctccgaaagtaggattcataatcgtattgtttttattcgttagggttacaaagtaagtacttttttgaagatttcattgcgaagaaagtgaaatccttcgcaatgaaatatcataaatgtcatttaaaaataaaagttggtacccggacagaagatagggtggctgctggtgttatcaatttcaatcttattttctctagcgagccaaccgatagcggaccatagatccgcatctgttagagcggattttgctctcaacgcctcaaaactccaatgttggccatctgaaagcaaattccagatagctcctgcatttaatccgatcgatccttttgtcatgataaaatctgtttttatgtttatggtatatagtgcttatattgttataacagataatatccggtaaaagtatgttgcgttgagataaataatctaaaaaacaaaaatctcttgatgcgttgaattttattccttgaagtcagcgaatatggattcatcgtatacattgtgttcctttttatcgtggaatggataccatacttgggcaaagaacggatttcctttagcgatctcgtcgtaattccaagggagcggtaaacattccgggcaccaatggcctcctaataatactaatgtgggagaggccttaaaacggtgaccgaattggcattcccaatcgagcggagtcgataagtctccttttgtcatggccggggacaagcattttcctcccctgaattctgcggctttacgcatatcctcgatatcccattccgacttcggcttactttcatcataaccatgatccagaaagacgggtgtttcggaggggcgttttgtccggatcttatcccaacccgggattgcttgccaatcctcatacgagccaaaataggcggatatacgatcttggtgtctgttcttgatccagttacgggttcccagtcccggctttttagcgatggctcccatacccagttttatgaagataggagggacgatctttgctaggtggaaataccaagggacttggctggccatccatttaaaataatcgtcgcaagtttggttactgcggaaatgcagatatccttccaataggtctgaatcggtataccattgtccgtggaaattacggatagcgaaccagttcggttcgaatattttctccggggcgggacagccgatcgcttttaacaatttactctcaaactcataattcgtcaggcggaaagatgggccgctactaatgttatagaaacggttccaaaactcatccggcacctcttcctcgcatacattcgctagtaagcgaccggaatcctcggcggtagcccattccagcacgccgtctagcggtacatggaatgtgattgggtccgaacccttgaataataattcggggcataagataccggtttggcgaaggcacgcccaatgtctaatacccgactccacgaaaatacgttcggctattgtctttgagatggcataatggtcataaacacttatattgatcggatctcccgtacgtccccaatgaaccggtgcgttacggtggccggtttgcgccacggagccgatatagactaccttgatctgatctgcgttcggttgcgcttttacggcatccacgatgtgttgagcggcggtcgtgtttactttcaaggtctttttagggaaataatccgccgccggcgaaaccattccacctacgtgtaatacgtagtccgctcctgttactccatttaggacatcctgataactcgtcaagtctccccaaacgatacggatccctgccacggcctcataggtggccaacttctctttattgattttgctcggacgagccaagagtgttatattaaaacgatctagccgcttggacaactcgaccaatccggcatggcccatcgtcccggtggctccggtcagaaagacggtctttttacttttcatgatataatttaagtgtataataaaaatcttaggatactatcgggtagcgaaggtatataaaaaaaaactcccaaccaataggttgagagcttttgtagtggatacgagaatcgaactcgtattacatgcgtgagaggcatgtgtcctaaccgttagacgaatccaccatttagatgtcattgtttttgtttgacgatgcaaaggtagatatattttttaattctgcaatagttggactgagtttttttgaagaaaaagtgtgttttttatcaaaatgccaagaaaacggggagaataccactaaaaggcgttaaaagtagttgcgatttcattgttttttcattgtcggtactgtttatttattctacctttgccatctgtaattgaacaaaatagtattgaacattactaataccagtttaataaacaactaatattatggcagaacttaaagaaaaacttttctcagaattcgcacctgtgtctactgaagagtggatggcgaagataacggccgacctgaaaggggtaccgtttgagaaaaagcttgtttggaagacaggcgaaggatttaatgtaaatcctttctatcgtgcagaagacatcgagggtttaaagactacagagtctcttcccggtgaattcccttatgttcgtggaacgaagaaagacaacgattggaaggtacgccagaacattgaagtttgctgcttcaagggtgctaacgagaaagcacttgaccttttgacgaaaggtgttacttctcttgggttcatcatcaaaggtgatgaggtgaacgaggagaatatagctactttattagaaggtatttgtccggcttccgtagaattgaacttcaacacttgcaactgcaaagcggagaagttgatcggtatcttggctgactacttcaaaggcaagggtgtcgacgcagagaagtgctacggttctgtaaactatgacgctttcaagaaacctttagtaaaaggtaaagaaaacagtgagtgggtagaaggtgccgcagctgtgctcaaagctggacaggctttgcctaactaccgtgtattggctgtaaatgcgttccttttcaacaatgctggcgcttacatttctcaggaattaggttacgccttggcttggggtaacgaattgatggcaaaacttaccgaggctggtttcaccgctgacgaggttgccaagaaaatcaaattcaattttggtatcagctctaactacttcatggaaatcgctaagttccgtgcggctcgttggttgtgggccgagatcgtagccgcttataagccggcctgcgaatgcgcttgcaagatggttgctcacgcacagacttcagagtggaacatgacggtttacgatgctcacgtaaacttgcttcgttctcaaactgaggctatgtctgccgctcttgccggcgtagactctatcacggttcgcccgtttgataagatttaccagactccagacgatttctctgagcgtatcgcacgtaaccaacaattattattgaaggaagagtgccacttggataaggtcgttgacccgtctgccggttcttattatgtagaggtattgacgaattccttggctgatgtcgcttggaagttgttcttggaggttgaggaaaaaggaggattctccgttgccgtgaacgcaggtgagatccagaatgccgttaacgcttcgaatgtagctcgtaagaaagcggttgctacccgtcgtgagatcctgttgggttctaaccagtatcctaacttcacggaagtagctgccgataagattcaggaaaaaggttcttgctgttgtggcggtggtcattgcggcgaggcaacgatcccggctcttgatttctctcgcggcgcttccgaattcgaggctttgcgtatggcgacagagaagagtggcaagactccgaaggtattcatgttgacgatcggtaacttggcgatgcgtttggctcgttcacagttctccgctaacttcttcgcttgtgccggatataagataattgataacttaggcttcgatacggttgaggctggtgttgaggctgcagtcaaggcgggtgctgagatagtggttctttgctctagtgatgacgagtatgctgaattcgctcctgctgcttacaaggctttggccggacgtgccgaattcgttgtagccggagctcctgcttgcgcggacgacttgaaggctcaaggtatcgaccagttcgtaaatgtaaagagcaatgtgcttgagacattgaaagcattcaacgctaaattaggaatcgcttaagtataaacaattatgagaccaaattttaaaaacatagatataaagaatgccggattcgcagctacaaacgctgccgaatgggcaaaagccaatggtatcgagcccaattggaaaacacccgagcatatcgaggtgaaacctgtatatacaaaagaagacttggagggtatggagcacttgaactatgcttccggtctgcctccttatctacgtggcccgtacagcggtatgtacgctatgcgtccttggacaatccgtcagtacgcgggtttctctaccgctgaggagtctaacgctttctatcgccgtaacttggcttccggtcagaaaggtttgtccgttgcgttcgaccttccgactcaccgtggttacgatgccgacaacgaacgtgtggttggtgatgtaggtaaagcgggtgtatctatctgttccttggagaacatgaaagtgttgttcgatggtattcctttgaacaagatgtctgtttccatgaccatgaatggtggtgtgcttccggtattggcattctatatcaacgcaggtttggagcaaggtgctaagttggaggaaatggccggtacgatccagaacgatatattgaaagagttcatggtacgtaatacctatatttacccgcctgagttctccatgaagattatcgctgatatcttcgagtatacctctcagaagatgccgaagttcaactctatctctatctccggttatcatatgcaggaggctggtgctacggctgatatcgagatggcttatacgttgtgcgacggtatggaatatcttcgtgccggtatcaacgccggtatcgatgtggatgcgttcgctccccgtttgtcattcttctgggctatcggtgtaaatcacttcatggagatcgccaagatgcgtgcggctcgtatgttgtgggcgaagatcgtgaagagcttcggcgctaagaacccgaaatcattggcattgcgtacacatagccagacttccggttggtcattgaccgagcaagatccgttcaataacgtaggacgtacttgtatcgaggctatggccgctacattaggacatacacaatctttgcatacgaacgcattggatgaggcgatcgctttgccgaccgatttctccgctcgtatcgctcgtaatacacagatttacattcaggaagagactaagatctgtaaggaaatcgacccgtgggctggttcttactatgtagagtctttgacgaatgaattggtacataaaggttgggcgttgatccaagagatcgagagcatgggtggtatggcgaaagccatcgagacaggtcttcctaagatgcgtatcgaggaagcggccgctcgtacacaggctcgtatcgactctggtgttcagaccatcgttggtgttaacaaatatcgtttgccgaaggaagatccgatcgatatccttgagattgataatacagccgtacgtaacgagcagatcgccgctttgaaggagttgcgtgctaaccgtgacgaagccgctgttcaaaaagctttggctgatatcacggagtgcgtgaagacgaagaagggcaatttattagagttggctgttaaggctgccggcttgcgtgcgtcattgggagagatctccgatgcttgcgaggtggttgtaggtcgttataaagcaatcattagaactatttcaggcgtgtattcatcagaaactaagaaagacgcagacttccagaaagcttgcgagctttgcgagcaattcgctaagaaagagggccgtcagcctcgtatcatgatcgctaagatgggtcaggacggacatgaccgtggcgctaaggttgttgctaccggttatgctgactgtgggttcgacgtagatatgggaccgttgttccagactccggccgaggctgcccgtcaagctgtagagaacgatgttcacgtaatgggcgtttcttctttggccgctggtcataagacgttggttccgcaggttatcgaggagttgaagaaattaggtcgtgaggatatcatcgttatcgctggtggtgtaatcccggctcaagactatgacttcttgtataaggctggcgttgccgctatctttggcccgggtacttccgtatcgaaggcagcttgccagatcctagagatcttgttaggcgaataaatagcatttaaaccttacggttttttaataaagagaggctggacaattgattttgtccggccttttttagtattgtatacgggtttatgtacttttgtagcgattattcaattaaaaagggaaagaatcatgggaatcgttataggtatagacgtgggaggtagcacgaccaagatcgtcggtgtggaggataagaagatcaagaacccgatgttcgtgaaagctaccgatccggtaacctctttattcggggccttcggtaaatatatttatgataataacatctcactctcgaatatagagaaagtgatcttgacgggtgtaggtagcgcctatatcgatcaacctttatatggcttaccaaccgcgaagacggatgagttcctcgcaaatgggctaggggcgcagtataatacgggactggatagcctgttggtggtcagcatgggaacgggtacctcttttgtcaaggtacaaggctccacggtcgagcatatcgggggattgggtatcggtggcggaaccatcctcggcttgtctaagctattattgaaaacgcatgactttcaccaaatagcgtctttggctgagcatggttccctgaatgatatcgacttgcatatccgggatattacgccgcatccgctacccggcctgccgctagacgtgacagcctctatttttggaaaagcggatgcgaacgctaaggttgaggatatcgctctcggtatcgttcatatggtcttgcagactatcgggcaaggagctgttttcgcctcgttaaatggcgatatcaagaatatcgtgttgatcggtaacctgactcgcttgccgcaatgcccggatattttcccccgtctggaggagatgtgcgatgtccatttcaagataccggagtatgccgagtatcgcacggctatcggggcggctttatgttatatcaggaaccgggaatatagggatattttttgtggaaagtgttaggctacatcaaaactttatgtatctttgctacatgctttgttccctttcggcaatcgccggatagggattaaaagggaatcgggtgagaatcccggacagtcccgctgctgtaagcttcataaacgggttgagcaatactgttgccactgttcattcaagtgaatgggaaggcgcttaagaccggaagtaagtcagaagacctgcaaggcgtgtatattttcgacggcttcgaggaaaggccggaagagaacgcaagaaccgtatccggtttttactattctttatccaaggttttcttatcaagtcgtctcatggtttcggataattattttgccataataattagggaaagaagcatgaatctgaccgacgggatgagctccgtatgtaagatgcatgctttctttgagtttaaaggactggggtattccgtgaacactctatagagaatatttgtttattattagaaaagtgcgtttatttgcaacgagtaattaacaaaagaagtatgaatatgaagaaaatcgtgggatttcttatggttgccttgttagcgttgatggcgcttccggcgaacgctcagcttaaattcggtatcaagggaggtgtgaatatatcgtctgtccatttcaactcggacgtgttgaaagcggataacgtaaccggcttccaagtggggccgatgatcgagacgactttgccgttggtgggtgtcgggatcgatgcggccgtgttgtattcgcaaaaaggtttggagacgacttcggttggcggggttaagacttcgatgaagacggattatatcgatgttccggtcaacttgaaatggaaattcggcttaccgatcgtcaaagcgtatctggcagccggtccgtatatcggtttccgtgtaggcggtgataaattttgggatatcccgggttccgtagcggatcaggtgaaggcgaagaatttcagcgcaggccttaacttcggtgccggcgtggagttgatcagccacttgcaggtgggtttcaattatggtctgggactgactgataactatagcattgagaaggtgaacctctccgacggtgccggaaagaatcgtggatggtctatcacggcagcgatcttgttctaaataggtgaaaataaaatgagagaggctgggctttagaagtccggccttttttgttatttttgggctcgtaatgaaacacctgtttgaatgaaatatgcggacgtcatacttccccttcctttggagaatagctatacctatcggatacccgaagatctggaaagagccgtgactcccggttgccgggtgatcgtgcatttcgggaagaaacgatattatacggccatcgtcatggaggtacacgaccgggaaccggtatccgattttgagacgaaggagatctacgctttgctggatgccactccggtgctccgccgtccgcaactccgtttctggaaatggatatcttcttattatatatgtaagctgggcgacgtgtataaggcggccttgccttccggcttaaagttggaaagcgagacggcggttacttataatgaggatttcgaggctaccgcccccttgcgcccgaacgagcaagcggtactggatgcctttagcggggttttgaaattgacgatctcggagttggagaagaagaccggtctccgaaatgttgtcccgatcgtctcttccttgatggtgaaaggggcggtcgaggtgagcgaggagctaaagcgaggattcgttcccaagacacaggcgtttatccgtttggccgaagcttactgggatgagacgaaattgcaggcggtgttcgaagaattgaaaagggcgaagaagcaagagcttctgttggtcagcttcttggatttaagccataccttgaatcccgctttatcgaaggagctttccaagaaagagctattggaacgcagtggttatacctctgcggtattggagggtctgctgaaacggggtatcttggagagttacgagaaagaggtgggtcgtttacaagtatccgtctgccgcttgcaagagccgaatccgctcagtccggcgcaagagaaagcctacggagagatccatgaggctttcaagacgaaggaggtttgcttgcttcatggcgtgacttccagtggtaagaccgagatatacgtccgtttgatccatgaggtcttgcggctggggcggcaggttttatatatgttgccggagatcgctatcacgacccagatcacggaacggctggcgaaattattcggggataagctattggtctaccactctaagttctcggacaacgagcgggtggaggtctggaacaagctgctgcatagcgacgagcctatgctggtattgggggtccgttcttccctcttccttccgtttaaggacttgggcttgattatcgtggacgaggagcatgagaatacgtataagcagcaagacccggcaccccgttaccatgcccgtaacgctgccatcgtcttggcgggtatgcacggcggtaagaccttattgggttccgccaccccttccatcgactcttatttcaacgctacggcggggaaatacggtctggtcgagctatccacccgctacggtgattgcttgatgccggagattattacggtggacgtgaaggagctaaagcgcaagaagattatgaaagatacccttttctcccccctgttggtggagaaggtgcgggaggctttatcccggggtgagcaagcgatcttgttccagaaccgccggggattcgccccgatgatcgagtgtcgggggtgcgggtgggtgcctcattgcgtgaattgcgacgttagccttacttaccacaaggcgcataatcagctggtttgccattattgcggttatacttaccgcttgccgcaggtatgtcccgagtgtaaggggacggagttcaagatgcaaggtttcggtacagagaaggtagaggaggagatcgctgggcaattccctgcggcgaaggtggagcggctggatttcgatacggcccgtacccgcacggcttacgagcggatcatctcggatttcgagaaggggaagacacaaatcttgattggtacccagatgttgtcgaagggattggatttcgggaatgtcagcgtggtcggaatcttgagcgccgatagcctgatgaatttcccagacttccgggcgcacgagcgggcttatcaattgatggtacaggttagcggacgtgccggacgacgggataagcggggtacggtgatcttgcagactacccagccggagcatcccttgatccgtatggtgcagcattttgcttataaggaaatggtgagcttgcaattgagcgagcgtagtatgttccgttacccgccttactaccgtttgatcgtcttgatccttcggagtcggaatgagaaggctttgcaggaaatgtctgctttatacgccgagaaacttcgtgctcgtttaggtgagcgggtgttggggccggttacgccgcctatcacccgggtacagacgcttcatatcaagaagatcgtcttgaagatcgagatatccgccgggatcgctccgcttcgtgagatattggaggggattcatacggagatgcagggatatgtgccgtttaagcagttgctggttcattatgatgtagacccggcttgagaattgaaaatggagaattgaaaattgaaaattaatggaaaggagcttagggatgagggaggaaaagatacggttgttgtttgtgtgtttggggaatatatgtcgctctccgtcagcggaggcggtaatgaagaagttggtgaaggatgcgggattgggagatcggatcgagatcgattccgccgggatcaccgggtatcatgagggagaccgggcggattcacggatgcgggcgcatgcggcccgtaggggatattcgttggattcgatctcccgtccggtacgtcagtgggactttcatgacttcgatttgattatcggcatggacgaccaaaatataacggacttgaaacggatggctcccgatctggaatccgtcgctaagatacatcagatgactgagttctcccggaataagttgtacgatcacgtcccggatccttattatagcggtgccgaaggtttcgagttggtcttggatctattggaagatgcttgcgccgggttgttggaatattgtaaagaccatttgtcttaagttcggggcgaagccggatcagtaaagaggttgttacggctatcgttcaacttcttttactaaccatttgatttcgttatcggtaatactttcactctcttccttatcataaatataaatgaggttgataatcccttcggtatcattaacggtataggtataggtgatgactcgtgcgccatgactttttcctttgtttttactgcctatagccatacggatcttacggatgccacagcctaaatcaattcctgcggaagggttgctgcttagctcattttgtaacgcttgaaggtcttgttttagcgaatgatatttctttgccaatcgcttcagctctttcagaaagtgcttttgcggtatgattctataattcatctatgacctcctgcaatgttttttgatatgtgccgtttttacgagactcttttacgtcgattaagccttgccggattccggcaagcacctcttccttactaatatattcagtctcttcagtctgtgcttccttttgctgcgcaagacggcggatggcttctacggctttacgcatcaaggtctcatcttcggcgatgatactgagttggcggaataattctgcgttgagttctaatgctgtcatatttttatccttcttttgtctctggttttcaatggcaaatatacgaaatagaatcagttagacaatgcttcggtagtttattcttgtgactgtctttattctattcccgtcccggatccttattatagcggcgccgaaggcttcgagctggtcttggacttatctatcgtaaggttgctagaatgcccattgtaagatgcttataactgcgattataagaacctaacaatgggcattctaataacctctttttgtgagagcggcgatgacagccgctctcactcgtgaaaccttgcctatcggattatcactttcttcgttatctcattggataggcggacgatatagataccgctagccaagccatctacacgactgtctccggcgggaagccgtaccgtgcggactacgtttccggtgagggcgatcacctgcgctgtcacggagactggcgtacggatcagcaaggctccgctctcggcacggatcaaggtagcgttttccacttgctcgataccggtcgtggtatttctcacgataccggtgatcgctacggtcaggttggcggaaatatcggcgatcgtgtacttgccgcttgcgtcgggggtgagggcgtttccgttcacggtcactacggggacggactggtcatagtctgcgtccaaggtgagggtgaaggagaagccgtcgccttcggttaccgtatgcgctccggctgccggggtggtggaggctcctaccaaggcagggagggttacggtataggtagcgggctgtggcgtaggaggcgttacgggaggaacataaggcgttacggcaaccgggggcgtggtgagcgtcgtggtcgtggtcgtgccgccgtctccggttacggtggcggtaactaggcaacgatactggcctacggttctcgtcctgtaggtattcgaggcgttacgcagctgcgagtcgtccggggcggtagaccatgtgccggcctgtgcgttgaaagtctcccattgatacgtcaaattcatttgggtgccttcgggggcggttatgccggccttaagctccgcgtagccgtcagtggatggtatcggggtgcttgccgccgggtctacccgttcgagggtgatgttgccggggagtgtcacggtgggcactcgtgcggtaagatccgtgaaatggccgttgttggtgaccgcggtgttgacaaggtcgccggcattctcgccgggggtgagcgtcaattcgttgccgggctcgatcgtgaccgcacccagactgttcgtgccgctcaaggtgaggttggtcttcccggtaccgttgatgagggtggccgcggaggttacctcgttgagctttattgtcatatcggtatcggcgggaggggtgagggtgagtttgtttatggtcttgcccttctctccgttgatctctccgttgaagtagttgtcggtaccatcatcttgttggaacttgttctcgtccgttatcgtgatctcgccgttgtctgccggggtgataggggaggcttcgaggtagacctgcgtggtgccgttcatcacgtacccattgcctttcacgccatcaggcagcggtgtggctgtccagatgaaggggttcttcttgccgggcgtgaggtcgagggtagcgccgtctttcagtttccacgagatcggactatctatcacgtcgcctctgtcggtggtgaaggtgagcttgggccatgtggcggcaagatcggccagtatctcatcggcggtcatgatggtggtgacgatccgggtctcggtcggctgtcctaccgcctctgccagctcgctctctttccattgggcggtgagggagagatcgccggtggagcctttcgccacggtcgctaccgtattcccgtcggtgtctttccagccctcgaaggagaggtaggtattggcgtgtgtcggcgtggggagggtgaactcgtccgatactacggtatattgggtggggctgccttgcgggagggtgccgccattcgggtcgtaggtgatcgtgtagcggataagctcggcctcggcggtaaccgtcgtcggctgggcgggcatcgtgaagctacgctgtgcggtgtagcccttgtcgttcggtgccagggtctctgcggtcgtagcgttgccgttgtaggtgatggagcctaccgtcagttggtagccttcctgcgggacgaagaagaggtctaccttggtcccgttgtagacggtctggccggaggatacggcggtgtacgtgccggcggcgttcatgatcattacgtccagcgtcgctccctcggcgggttgctggatggtgaggaggtatgggaagaccgggtcggaaggttgcgccttcgtgctcgtctccggggcttgcgccatcgccggctgcgctagcagggcgagcgtagcggctagcaaggataggatatatctgaatgttctcatatttgtatctgttttagtgtatataatataatgtatgctctacaggacgaccttgatcgttgtaccgccttggtggacgagatagatgccggaaggaagggcgatcgtcgtctcgctgcgcaagagcggcaggtagcacttcaaggtcccgctgacgtggtatacggcgactttctcggcatggtcggcgctaaggtgcaaacgtccgtcggcggcccaagcgcggaagctgttgtccgccggagtctcggccagctccgtacccgtgacgataccgtccaagcggaggctcttcagcagggcttgggtggcggcattggccacgacatagctctcgaagggccgcagggtaacccggtccttcagctcgaagcggctgccgtcgtcgctgaggacgtatatgtttcgcatctccacattgtacgaggcccgattgcccttgaagaggaacacgcccgtgttgagcggctcggcggggctggtaggctcgatgggggagtcggggctgtccttgaaaaggtagatattgccgtaattgaggcgcagcgtgtttgtctccgggccttcgccggcgatcagcacggggttacctgcggcgagtatatgcaggttgtcgggatccgccggctgccaagtctggtcggtggcatcgggatatccggtacgcacgtagcagggggttcccgcgtcgctagccaatttgtcggcggtattggatgctagcgtggtagcccgccattggttgcggttggggaagaggtgggtgaagcgggccgctacgagtcctagcacaccgtcatcggcgaaccggatctgcccgccgtcctgcagctcgagatcattcaccagtggaaatactccattttctcctatcttccctaccgtaaggacacccttctcggtgacgcgcagccattggcccggcatgctcgcgtcgaaggccgtctccttgtcgatcacgatccagacgggcgggacttcgcgcaatcccgtgtagcttgtcagcccgtcgggatgggcggcggggaaggtgctgaggtaggtttgccccgggtcgtcggagcggtagccttcctgtttcaagcccgtcgactgattctctaggtagaaggagagcgggtagttcgtggctatgctcttcatgcctgtaagattgaaggtcagaccattcggattctccgtcggttccgccggtttgaggtagatgtagccagacggagattccggccatgtgagttggacaaggcccttcacggtgccgccgccttcggggtggatggcctgctcggcggctgtcagcgccaaggtgttatccgggtcggcgggcgtcgggatgaggcaggtggctcccgtctctacccggagcgcgtgggttccggacaggcgggggctgtgggtgttgttttggagcctcaccgtcccgctcgctaccgtgagggccgtgcccgtcgggggctggaaatctaccttgtccagcgtaagcgtagcctcgccctcggcatggatggtggcggggatgttgatgtaggatgagctgccgtttgtcgtcaccgtcccgtcgaacatcttctcgtcgcagtaccatccgtccgcggggtcgaagaagaggtcgatgccggtgcgggtgctgccgtagccgtagtccttggaaaggtcgagcggctgcggggtggggcgggtggcggtggcgccggagtatcggcagtatgccccgtctgtccggaagaaggggtagtctccgtctttataggaagacccgctgtaacgcctgccggcatatagccgctcgccgtcgagggaggcggtataccgcgtatcggccgcggcgaggaaggcgtaaccccagcaggtcccgtcggtcgcgaaggtggccgccggctcgtcgtcgcctgccggggtgacggacagcgtccggccatcggtcggggcggtatcgaaatccagttcgataaagccgcttacataggtgcagagcgcgttcgcttgcaggtggatccgtgcgttatccccgaacgtgatcgcgtccggcgaggtattgtcgtttttaaaggctgagccacctgttttactgatgacatgtatctctccgtccagatgcatccgggcattctggaagttggagatggcgccgatgctgagcggcgcttgggcatagaccgtgagcgtacccgtgcccgcgggagatccgtttaggataccttggcttatctcctgcgcatcggctacggtcagggtgagcgtgcctaagttatagatgaggtcgctcatgatctcgatccggttctccccctcgatccggagggtcggttccgcgccggccttgatatagaagagctggttgaaacttgaggttatgacggcgtctttcagcgtcagcgccggtgggttgccgctgtcgggatcggcggaggtgagtacgctgtcggaatcggtggaggggtgtatgacgaactgccggcctacctcgggcatcgtgccggtgatggtaccgttgaagggggtgccggtggtcggggcctgcgtgtcggatgcccctactttgtacacccacgtgccgtttaggtacgcgaggttgatgtaccagttattgttcagggtgcccggcagggtggcaaggtcgagtgccccgggaggttccgcttgcgcgcgggccgctgtcgggagggtggcgatcagtgtcgcgacactgatcagcaaggcgaatattcgccttgccggtaggtggatgtcatgtaatgatgttctcatgttctatgtgtataatagggtttataaatcggttgttttttccggcaggtccggtagcccctgtccggcaggcttggcagccgttgtcctcgatgcttggcagccgttgtccggacatgccggacaacgttgtcctcagatctcgtccggactctcgctgtcgcccccaccgccttctcctacgataaggatgatggggaaggtgtaggtgcggggctcttttacgttacggcttccgctgtattgcgtggtgaggctcacggtgtactgcccgtcggccagcgtcggcatctgcacgatcacctgcgagggcgagttggcgatcaccacgggtgccttcatcggcgcggccccttcggtggtgggggtgaggtagacaccgatggagggatcatcaccctgtatcttcaggttcacgccacccagcacgagggctccgccggagctgagctgcccgttgatggccttggaggtggagtcggtcacggtattgatcaccggacctacggccgccacgccgttcaccaccaccttcaccagcttgagggtctcgcgcaagagcttgcccatggtgtaggtgatgccgagggcgtgcttcccgggttcgaactgcgccttctcgccctcgaaggccccctgcacgttgacgaggtattggcccacgccgtccaccacgctcttgccctcggcgatggcctgcaccttatggctgtcggccatgtcgaggatgttgaggatcgtgccgtgttggtactcggtacgcgcggccacgatgcgggcggcgatgtccgtgttatacaatgtcccggtgatgtgcggcttggcggtgtagtcgcccttgcgctcggtgagcaggttatcgtacaagtctgtgttgagaatgatttgttctgccatggtattcctttattaagtgattactgccagcaaagaacggggttcggggtaagaatgagaggacaaatccgggaaaaaagaggacagatctcggaaaaatgctcattattgcgcctgccgccggtattgggcgggggtgactcccagtattttctggaagatacgcgagaaggtgcgggagctggtgaagcccgcgccgacagcgatctcttccatgctccggctgtcgcccggcatcaacagctcggtacgggcgtggttcacccggtagcggtcgatgtattccttgagcgtgatgttcagcttgtccttgatggaggtggagagatacttctcgttggtaccgagggcacgtactaggtcttgccggctgaaattcgggttgaggaagggtgaggagctggccatatagttttgcgcttgctggaacaactcgtcctcctcgatttccagcaacccgccgataagatcctctaggtccatccggttgggatcggtatcggcgtcggcttgcggggcgaggttgagccgtaggtatagttggtcgtacgtgtaatggtagttggcgtagtggatcgataccgaggcgtagaagagggcgaacacgaagttgaccgccgtgttatagtaattattcgggaagaaacagaggctcacggcggcgatgccgatacccagcgcccataggaaggcacgggttacccagcgcaattccagtcgctcgggtgattggggtatctgtttcaggttacctagatagatcgcccgctcccggaagaaaaaatgcgtatagccccctagctggacaaggtatacgaggcacgtgagcgtacgtatcagcaggggcgggttcccaatattatcccaccatacgtcgaaacgatacgtatggacatcctcccggaagagacaagcgatcgtgtaggctacggtaagcgcgatcgtaggcatggcgtggaggaggatattcctccgggtcacgttctttcccctgaataagagggtgagcaggaacgtgaacagcaacgcttgcgaggcgctgattagcaggatggggaagtagaacaactccatgatggttcgctcgtccgtgccggaagacaagatgaagatatgccctatgcctaccaatgccgaggccaaggcgagatacttgcaggccgtccggtacttggggatcgtgctttcccgcaaggtcttcagcgacaacagcagtccgctgaccagaaggcaggtaaaggctacgatccctgtcgaggctaagtagagtaggtggtcgttcatgttggttcgctattgttttttcaagtccggatagctgattcgggtatggaacatggttttcagtttgtctacgaatacgctctttatggtctccacgtccttgaaggtcaggggagcgctctttagcaagccgtcggcgatctgcccgtcgatgatcttgttcaccaaggcgctgatactctcttcggtatgttccttcaagctgcgggaggcggcttccacggaatcggccatcatcagtacggcggtctccttcgagaagggattcgggccggggtaggtgaatagctcgtcgttaatcggcttgtccgggtattggttcttgaaagagttgtaaaaatacttcgccttgccacgtccgtggtgcgtacggatgaagctgataaccgccttgggtaacagggccttctcggcgatcttcacgccctcggtgacgtggctgatgatgatctgcgcgctttggtcgaacgataactggttatgcgggttcacgctcgattggttctcggtgaagaagacggggttgctcatcttcccgatgtcgtgataaagggcgccggtacgtaccagttgggcgttggcgccgatcttggcggccgcctcggaagcgaggatggatacctgcaaggagtgctggaacgtgcccgggcaagtctcgctaagcttcttcaagatcgggttgttgatgttggacagttccaccagcgtgatgctggacacgtatccgaacgtcttctccaacatatataccaatacgtaggtgaacatcagcaggatgaagttgataccgaaataaagcatcatcatccagttgatcttgtttaagttcgcctcttgatacaacgtgagactgaggtagcaggcggcgtaggagatgaagatgaagacggcgcaacggatcagttgcgaacgttcgctcaactccttcaagctgaacgtcactaccatacccgccacgatttgcaacaacaggaactcatgcgggaaaggtaccatcaacgagcagatcagcacgatgataaggtgcgtgaaaagcgccgtccgggaatcgaagaaggtacgtactacgatcggtacgatggcgaacggcaatatatatacgttgaataatgcgtaggtaacacatagttccgtaaggatgcaactcacgaatatgcagaggatcaagaatagtacgttcttccggttatggaatatcttcaagcggaaagaccataggtagagccagaaacagaacattagcccgaagacgagcacgaattgtccggccaatatgatgccttgcgtctgcgtgccccccgtcttggcctcgtgtatggcctttagggaacggagcacgttgtaggtatggttgtcgatgatctcgccccggtctacgatacgctctccggcttgtaccataccgttagcgatagatacgctctgtagcatatcctccttgatcttgtcggacatgtcggcggcataggatatgttctcggtgaggtagttattgatgtcacacgattgcaggatcgatttgtccagccgcggcgggcagttgttgataatgaactcgtaggcggtgcgcacggtgaagaagtcgctcacgtagcgaggctgtgcgacggcgttctccaagaggttgacacgggagtattcctctttccgtagctcgtccagatcctgcgacgagatgataccgttcttgtataagttgatcaggctgctctctatatactgcatgtaagcgggggatactttgcttcgcaagttattgccgttattgtagttggcacgcagtttctcgacctcttgcttctggatgtcggggttcatgcggtaataaggctcgaacttacggagtacgctgtctttctccgcttttacctcgtcgtcggtcttgtagatcgggaaatcgctcggggcggtgagtaatccatatctccaaggcttgccctcatagaactgataacggaattttccctcccgagggaagaagtaggcgataagtaatgcggtcaccacgaagtagaccacggtcggtatattgtaattcttctgtttcatatagattcctttttgcgtccgaaatatacgtaaaaaacttcactaagcggaaaaaaaggcgtacttttgccgcattattatagaatgtaagtattatgactcaaagaaaagtaagagtacgcttcgcacctagtcctacgggggcgctgcatatcggaggtgtccgcacggctttatacaactatttattcgctaaacagaatggcggtgatatgattctccgtatcgaggatacggattcccaacgcttcgttcccggggcggaagactatatcatcgaggccttgacttggctgggtatcaagttcgacgagggcgtgagcttcggcggcaactacggtccgtatcgccagagcgagcgtcgtgagatctacaagaagtatgtcgatcaattgctgaacgatggccatgcttatatagcgttcgatacgcctgccgagttggaggagaaacggaaggagatcgccaatttccaatacgacgcctctacccgttcgcaaatgcgcaactcgttgacgctttctcaggaagaggttcagagcctgatcgagtcaggtcatcagtacgtagttcgtgccaagatcgagccgaatgaggatatccacgtgaacgacttgatccgtggcgaggtcgttatcaactcctctatcttggatgataaggtattatataaatcggccgaccaattgcctacttaccacttggcgaatatcgttgacgaccatttgatggaggttacccatgtgatccgtggtgaggagtggttgccgagcgcaccgcttcacgtattattatatcgtttcttcggttgggaagatacgatgcctagtttcgcccatctgtcgttgctgttgaaaccggaaggtaacggtaagttgagcaagcgtgacggcgatcgtctgggcttccctgtattccccttggaatggcacgatccgaagacgggtgatgtttcatcgggctatcgtgagagtggctacttccccgaggctgtcgtaaacttcctcgctttgctgggctggaacccgggtaacgatcaggaggtgatgagcatggatgatttgatccgtttgttcgacctgtctcgttgcagcaagagcggcgctaagttcgattatgagaaaggcagatggtttaaccaccactatttgctggagaagagtaatgcggagatcgccgacctattcttgccgatcgtggaaagccatggtatccagactacccatgcttatgtagagaaagtggtcggcatgatgaaaggccgtgtcaatttcgtgagtgagttatgggatctttgctctttcttctttatcgccccgacggagtacgatgagaagactcgcaagaaacgctggaaggaagattcggctgttcaattgggtgagtttatcgagcaattgcgtgcccgtgagccgttcgacgtagaaggtaccgagaacgagtgcaaggcttggatcgagagcaagggatatcatttggggaatatcatgaacgccgcccgtctggccttggttggcgagggcaagggccccggcatctttgatattaccgaggctttaggtaaagaggagtctatccgccgtatccaacgggctatcgagatattaaaataatcatgtacagtttagcaatacatctctacgcttttgtagtcgctttgatctcgcctttccataaaaaggcgagactgatgcgattcgggcaatggaaaacaaattccatacttcgtgagaaaatcgaccggaacgctaaatacatctggttccatgcctcctcgctgggcgagttcgagcaagggcgtcctatgatcgagaagatcaaggcggaacatccggagtataaggtgctgctgactttcttttctccatctggctatgaggtacggaagaattacaagggagcggacgtgatctgctaccttccttttgatacgcctttccgggtgaagaagttcctgaatctggcgaatccggcgatcgccatatttatcaagtacgagttttgggggaactatttgcgtgagttgcggaagcggggaataccggtttatatcatttccgctatattccgccccgaccagctatttttccaatggttcggaaagccgtaccggaagatgctatcttattttaatcatctttttgttcaggacgagcgttcgatgaaactcttgaacgagttcggcatcacgaatgtgacggtgaccggcgatacccgttttgatcgggtgttggatgtccgtaagcaagctcgtgagcttccgtttatcgaacgtttcttggaaagcaaggaaggtaagaggccgatcgtgatggtggccggcagttcatggcctcaagacgaggcgatctttatcccttatttccatgagcatccggagatgaagttgattatcgccccgcatgagattcaccgggaacatctcctttctatcgaggcgatgctaaaacgtccgtccgtccgtctatcggaggcgcatgaggatgatctggccgataaggattgcttgatcatcgacagtttcggactcttatcttccatttatcgctatggacagatcgcttatatcggtggtggtttcggagcgggtatccacaacacgttggaagccgccgtttatgggatgccggtcttattcggtccgagataccataagtttaaggaggcgaaggatctgatcgccgtaggtggtggtttctccatcacagacgattcctctttccgaacgaagatggacgagttattgaccgacccgacagccttggaaacctccgggcaagctgccggtgattttgtgaaaaacagtgtaggagcgacggatcaaatcttgcgacaaatccatatccgttaatagataaagccgggtttgctattcgagtgattgtatgcccagattcttttgatatagcaatggaatacggatgagatagatgtacggattggtaattgaacgatttgcgttgtctatctcatccgtgttttattttaatcctcttcagcgaacatcgggtcccaagcgggaaggcgagtcggtgtttgtttcaagatctcttttacttgatccgtgatgtacttcttgttgactaccagacggaacatatactcattaaaccattggtctgtcatgatgaggtggccggcgttcgctccggggccccaactattctcaaccatccatttcttcggctttccattcgcgtcgaggtcaacagccatcaaggtcatggcgtgtgaggaaccgctggcgaatgtctggatacgttgtttcttatccatgccgaaagtcgtacccatcagtgaaccgtaatcgtagaagtttacatccagaatacctctgtcacgatcgaagaacttgcccacgtcgcaagagaaatacatcatggtgctgtccttgatggaagcgatagccatttgtttgatatcctcgatcggaaggtttacgtaagtccagttctttccatcgtaagcgtggcggtcgtaatcgatctcatacaacttataataatcgcggctcggatcgttcatcaacatgacatagttgtttttcaaatcgtccccgatatattcttggaagaaggactgaggcgtatattccttcgtctctaccggattccctttagcgtctttgcgagtccacgtgaatttcgtaggcggctctcccaagttcaatacgagcatacggtaaatcgtacctagcatctcggtcttctttttctccagatccgctacggtcgtgcctttggtcgtagacaggtcacgaagttgcaagccgtattctttcagctttaatccgatcaggttgctcatgcgtccggtactgttgctactgttggtctctaccatgacctcggcgggaaccacgccatacttggtcaagatatcggagacacccgtgaactgccctccgtctccgatcgggttcttgaacagccattccaccatcttgtcgtccatcggtttcagacgagtatcgatgatgccctgtaagaaaaggttcgctttctccaattgatcccagaagaaagaataattctgggagaattgaaagtctcccatgtcatatttggcgatggcctgcgcacggaacacgttcaatcccgtgaaaagccagcaacggcccgaggaacgttggttggagatccctttgctctctaccttattggagaagtaagtatccaaattgttcttgctctccccattaacggcaagcttgttgatgtcgttattggtgatcgcgttacggatcgccttatcggtcggcgttccttgataagactgtttgatttgctgcaacatcgtgggtgagatgcctccaccactttgttgtccgtgagccgatagcgtgatgcctaaagccaaggccgctatccataaattcttttgcttcatgatattttagttgattaataaattgtgttatttctttttaggccataccagaccgtcttgccggatattccataccgtaccgtctggtgcgggtagtgatatctcatacatggaaggtgtcgtatgtatttccagttgattggcgatctcttgcgggcatagctcgtttgccttcaagtcgttgatgttatcggcataatgtccgaaggtcgcggcgaactcattctgacggtaatataaattacgcaagatccatttcgtctcctccgaaggatgttttacgaaaggagtctcaccttctcccgcaatcttatccgatatttgaacataaccccagtattcgggcatatggatattgattaccccggtaggcgcccatacccagttgtactcgcgaatcttatcctctccttggatagggactttcacgtatttaccgtctttcaggtccgttgtccattccacacgagagaagttcacacggatctgctcgccgatttccggcttttcttttcctctgtccatttggaatacggaagtccaaggaatgaatacctctacgctccatgatttatccgtgtctttcgggttattcagcgtaccgtccacataaacagcggatttcattccggtaaactcccagttattcaatacttgcggattatcccgataggggcgggttaagaacaagtcccattccgtacccaaggcgttcacctcgtactccagataattatgggtgtcgttcgtaggattcaggaagatctcgaagtcgttgtcgtggaagatcacggcgtcgtgttccgtgatggtcgcccatacgtgcggctcctccataaggacggcgaagtacattccgttatcatcgtaagtcatcttggcccgggtctggaagtgaggggctgggcgtttgtcgccttcgatatctacgaagtcgctggtccaaggtatcgcgtcccattccccgggagaaagctttccgtcgatcttgataggagcgggggccttgtagcaaacatacgtcggcggattgaacggtggttgcggcatatacgtgatgtctggcttttgcgtactgggtttctgtgcgcaagaaagcaataggagtgccgccaatggcgctgtcgttaaaatcgtttttctcatgtgcgtttatttttagatcgtttgataaatagattcttattgaagtaagtccatcgccgcgtccaaccatgtatttatatcgtccggataatgttgatcggcggtataagtatcgctgcgtttgtgcccgagtcttacgatcacggcgttcttttccgggagcgtgaagacgtattgccccaagattcctctcatataagggatcttcatccctttgtaatcgagaatccagtattggaatccgtaacaatggttgggtttgccgagatccttatagacaagacgggtatcggggcttgtcgcttccgccagataagcgggagagatcaattgccggtcatcccattgaccgttgttgagtaataattgtccgaagcgggcgaaatcacgggcgttactgttgaaacagcaataggctttttccatgccgtccttccggtcgaggctccaaagggcgctttcctcggcgtgcatcggagtccatagtttgcgggatacataatcgctgagtttctccccggtagccttctccacgataaagcccagcagttgtgtcacgccgctttggtagataaagtttacgccgggctcgtcgatctctttcatcccgaaggcgatttcctgtaggtcatcgccataatacaactgggtggtaggagagaaaggagagctgtaagcctcgtcgaaatccacgccggcgctcatggtcagcaaatggcgaagcgttagggcctttccgtcgtatcccttgaattccgggaaaaagtcgcttaccggttgatcgacattgcggataaatccatcgtcgatagcacagccgatcgctaacgagacgatgcttttcgccatcgagaaggaattgctatgcgattccggggaataatcttcccaatattgctcgaatagcagtcgattgtcttggatgattacataggcaaccgtacccagctcctcaaaccggggaagataacgctctggaatacttttcgtattgtaagcttccgatagttcccaagggcggggcgaacctgcttttacgacccggttctcgaaaatcggatattgatcgatcttgggtaacaaatggataagggccctacgtagataataattggagggtaacgccagatatccgcctattcccagcataaaaataaacactatccatcccactcttcgggacaaatagtgtttattggctggaaccctattatttgaatcatttttcatgtaaccctttggttgttactttacagatacaaatatatggtttataattcaaataatcaaatacatgctattattctttataccaagaagaatacatatgatagttcttggctatcttttggttgatctccttcgcttgctcgggatctaccttcttgacgaacttagcgggaactccggcgtagatgctgcccggctcgacgatcgtcttgcttaatactacggaacctgcggcgatgatcgctccctcgcctactacggcgtgatccaataccacggagcccattccgatcaaggcgccattgcaaatcttcgccccgtggatcgttacgttatggccgatggatacatcatcgccgatctcgatcgtcgatttctcatataaggtgtgaaggacggaaccatcctgtacgtttacgccgttgccgatgcgaatcgagttcacgtcgccgcgaagcacggtgccaaaccagatactgcaaccttcaccgatctctacgtcacctataatcgtggcgttgtctgctaaaaaagtgtctttaccgatcttcggggtaaagccacgaacggatttaattaatgccatttttagttgtttaaatttctgttgttttctctttcagccaagctttctcctcctcgttcaagaacgggctgatcttgtcgtagaccatttggtggtacttgttcagccaagcgtgctcacggacagagagcatggggatgataatcaagctcgtgtcgatgaaacaaagcgtcagcgtatcgaatcctaggaatttcccgaattccgtttcgctgtcctcacgtaccaagatcatgttctccgtacggataccgtattcgccggtacgatacatggccggctcgtcgctgatcaccattccgggcttcaaggtcaccgggttctcctccatgcggatgctttgggggccttcgtgtacgtttaggcaatggccgataccgtgaccggttccgtgcaagtaattaatgccggaatcccatagcgccttacgggcaaggatatcgatctgagagcctcgtgttccagcgggaaacttgcttttcgccaagctgatcgtacctttcaatacacgggtgaaatcctttttcatctgctccgtcggctctccaagggcgatcgtgcgggtgatatccgtcgtaccgtccagatattgcgcaccggaatcgatcaaaagcaatccctccggtttcaaggtcgcgtccgtctccggcgtagcggaataatgaacgatcgctccatgctcggcgtaaccgcagatcgtgccgaagctatccatgatgtattgcggttgttccgcacgtaaggctgtcagcttctcggcggcgctgatctctgtaacttgggctccttccgccatttttttctccagccagatatagaattttgtcaaggcgacgccatcttttaccacggcgttttggaatcccttgatctcggtctcgttcttgatgctcttcaagtgattggcgggggagatcccttccacgatcgtacagcttcccgggatcgcatcgtataaggagacgttcgtcttgttcatatccacgaatacccggctgttttccggtaggcgggacagatacctctggatcatggagtattcggccagcgtaaccccttctttcttcaaatgctcggtgatctcggcggtcagcttctccggcttgatgaaaagcacgctctcgtcctccgatacgaaggcgtagctgactacgaccgggttataggtcacgtccgtaccccggatattgaatgtccacgcgatctcgtccaaggcggcgaggatcaagcaatcggcgccctcgctccgcaactggttattgattaggtctagtttctcgtgcacggaggctccgcttaatgcttccggcatctcgaatatcgggtttccgggaacggcgggacggtccttccagataccctcgatcaggtcggccgaggtatccagcttgatttctttacggcttagtttatttgccaaggcactcgcttcggcggcgctataggtttgcccgtccagccctacggcctgtccggcgtgtaactcatgcaagaggaattccgtgatagacggtgtctccggaagcgccaacttatagagttcgataccggaaccttccagttggctggccgcttgcaggaaataccgggaatcggtccataagcccgccttgtccgcggtgaccacgatcgttcccgccgagccggtgaagccggatatccattctctcgatttccagcgatcggccggatactcgcttagatgcgggtcggaactgggtatgatataagcgtcaaccttctgttgtctcatagcctcccgtagggcggcgatacgttcaggaatgtttgttttcatcgcattttattttagtcaacattaatactcgcaaagttaatgaattattttggatttgtctcgccggaaaccggctcttctaccttataatatagatgggaagtacctagcttttcccaccgcagtttcctttcctctaccagccgccgcaagtcgagggaagccttacttctggagcatccgcagagcgacatatacttcttctggtggataaaagggttcgtctccagataacggaatacctcttgctcgcattccttggcggagggatacgcaggatcgctaaccgtgtactcgtcacgaaacaccggcatggtcttcagccggtctcttagttccttggacgatctgaacttcacgtccttgaaatggatggattccgcccggatctcattcttttccatcacgggccggcttttcagtgagacgctgaaagtaccgatcccctctagctccacgttataaccgaacatgaggaagtccaccatcatgtcttggaaaagctgcaagatccctttcatatccgcgggcgagaaagaagaccgggacttcgctctattgatgaactcatccgtatgtatcgtcccgcaagagaccaaacgaggatgtaggggtaatgacttcccggattcctctggattcgggttggggtttctgactagcttgtaatttgctgacatctgtgctgtgtttaaatggttatagatcttttgtctgattcttctggatcgcttacccgtttctataggcgagcttagcggtttcttcaagaaggattcatcttccaacagccgttgcatgatcatgcaccaactgttggacgatcatctaccatctgttggatgattgtccaacggatggtagatgatgaatacttcagcttcaaaggtacaacatataaaggagaaaagggttaggatttcagataaaagagctaaaggttatgataaacgtgtatgggctcacaaccttgtgaaccgatccctttaaatcaagttaaagataaggcacccaatagatatcaaggaataatttgctagctttgtagaaacaaataagaagtgccatgaggaatctgctttatctttttgtctttgcggctctgcttctcggcttgagcgcatgttcttcttattattattcgatgttgaactcgaatgaccccgtcggggagaagaatgagagaggtgattttgtgcaggaaaacgatacggtacgtatctcttatcgtttctggggagagaacgccccggttactattaccatttataataaattgaatgaacccttgtatgtggattgggggcggtcggcgctgattatcgatgacgtggctaccacctacgacccgaaagtggcctcggtgagaggcgagagctctagcgtggcatccggtagctcctttcattggagcgataggagcagcagcgggtggagctactcggaaggttccttctccggtgatgtgagtttgccaaagggcgttgagtttatcccgccgcattccaaattagtcaatacgcctttgcaattagccaacttcccgtttaacgagatcccgaaagaagagtatgtaaaggaacaaatgacaacgaaagcaaacacaaccgtaaatatccgagtgaaggattttacagaagaagattctccgctgagattccgtagctacctgacgttgttcgccggagggactaatgggaagcccttgaagcattcctcttttgagcggaacttctatctggcgaaattgatcaaggtcggcgacgtggctccccagtatttcgatgagggacagcagcaatccggcgatttcttttacgtgaaagagactcatggggctacggcaggccttgtcgtaggagcgatagcggttaccgccgcaggggtggcgatagaagctacgctgggtcccgtgaactattaatatattcatatcgaatgatacaaactctatctgatttaaagaccgtgcgtttcaacgagcaagcggacggtgtgatcattttggaccaaactctgctgccgggtaaggaagcgtatctgacccttaccactgccgaggagatatgggatgccatctataaattaaaggtacgtggagcacctgctatcgggatagcggccgcttatggtatctatgtctgcgcccgtcggatcgatacggcggagaaatccgttttcgtggatgagtttcggaagatcaaggagtatctggccggttcccgtccgacggcggtgaatctagtgacggcgctgaaccggatggagcgggtattggtcgctcatccaaccttgtctgtcccggaatggaaagagctattatataaggaagcgatcgcgatccgggaggaagacgccgccgcttgccggcagatcggcgagaactgtctggagctactccgtcccgggatgggaatccttacgcattgcaacgccggacatctggcggtctcggagtatggcaccgccttggcgccgatttatctggggcaggagagaggctatggtttcaaggtcttcgccgacgagacccgtcctttgttgcaaggcgcccggctcacggcctatgagctaagcagggccggcgtggacgtgacgctgatttgcgataatatggcctctatcgtcatgcggaaaggctgggtgcaagccgtggtcgtaggttgcgaccgtgtagccgccaatggcgacgtggcgaataagatcggcacgtccggagtggctatcttggcccggcattacaagatccccttctatgtattaggcccgacatccaccatcgatagctcgtgcccggacggcgattccattgtaatagaggaacgtaaccccgatgaggtcaccgagatgtggtattcaaggcgtatggccccgaaagacgtaaaagtctacaaccccgccttcgacattactccccacgagctaatcacggctataattacggagaaaggcatcttttataaaaataatcgctgaaagttttgctaatcccgaaacaatcagtaattttgccgctcaatttgaggatataaataattaaacaatataacaatttaaattatgatcgtagttccattaaaagaaggcgaaaacatcgagaaggcgcttaagaaattcaagagaaagttcgagaaaacaggtgtagtcaaggaattgagaggccgtcaggctttcgagaaaccgtctgttacgaagagaaagcagactatgcgtgctatctacgtacagcatttgcaacaagtagaagaataattatagcttccgggcttgttttattgaattcttattcctattttcgttgcatgaatgttgatgcaacgaaaatatgctgatcgatgactttctaaactatctccggtatgagcggaactattccaattatacgattggtgcctattcgaaagatttggaccaattccagaggtatgtaagagagcatcgagaaggtgtattcaaccccggggaaatcgactcggatttcgtgagaagctggatcgtcagtttgatggacgagaagctttctcccgtatcggtaaaccggaaattaagttctttgaaatctttttttaagtttctcatgaaacgggggattgtctccgcgaatccgttgagattggtgagcggtccgaaaacgaagaaacccttgccttattttattaaggatagcgagttggaggcgttgttggacggggacggatttgatgaggattttgaaggtgtgaggaatcggttggtcattgagatgctatacgataccgggatgcgccgctcagagttaatcggcatacgaaacgtggatgtggattatgaggcgatgcaggtcaaggtaaccggaaagcggaacaagcagcggttgattccttttgcggagggtttaaaaaacttaatgcttgcatacacggaagtccgtgatcgtgaggttgaggcagccggtgaatggtttttcgttcgaaagaacgggaatcagttgtcgacggggattgtttataatatagtaaaaaagcaattgtcggagatacccatgctggcgaaacgaagtccacacgtgttacgacattcatttgcaacgagtatgttaaacaacggagccgagctgaacactgtgaaagatttattaggtcatagcagtttagcgtctaccagtgtttacacgcatacaacctttgaggaattaaaaaaagtgtatcatgctcatccaagagcaaaaaaagaaggaggttattatggacgttagaattcaagcaattcatttcgacgcaactgcacagttggaggcgtttattcagaagaaagtttctaaattggagcaatacttcgatggtattatattggcagaggttacattgaaggtggttaagcctgagacggtgaagaacaagcaggccagtataatgttgtccgtgaagaacggggaatgtttcgctgataaaataaacgatactttcgaaggggcgatagacgattgtgttgaggctttggagaagcaactggttaaattcaaagaaaaaatcagagccaaataaaaaaaacggtagataaatttggtatgtaagaaataatatctaaatttgcagccgtttcgccgtggtgacgaaacggctgcttttagaagtatcgcctctttagctcagttggccagagcacgtgatttgtaatctcggggtcgttggttcgaatccgacaagaggctcaaaagaatgtattggaatgggcagttaccagagtggccaaatggggctgactgtaactcagctggctttcgccttcggtggttcgaatccatcactgcccacacgaatgaaacaaaggagagaatcggttggttcattcggtcttgcggaagtagctcagttgatagagcattagccttccaagctgagggtcgcgggtttgagccccgtcttccgctcttataagttgcctgtgtagctcagcggtagagcacttccttggtaaggaagaggtcccgagttcaagtctcggcaccggctcaattgaaaattgaacatgatcattaatcaaataaagaacaattaagttatggcaaaagagaaatttgacagatcgaaaccacatgtgaacattggtacgattggtcacgttgaccacggtaaaacaactttgacagctgctatcacaacagtattggcaaagaaaggtctttcagagttgcgttcattcgattctatcgacaacgctcctgaagaaaaagagagaggtatcacaatcaacacttctcacgtagagtatcagactgcaaaccgtcactatgctcacgtagactgtccgggtcacgccgactacgtaaagaacatggtaactggtgctgctcagatggacggtgctatcatcgtagttgctgctactgatggtcctatgcctcaaactcgcgagcacatccttttggctcgtcaggtaaacgttccgagattggttgtattcatgaacaagtgtgacatggttgacgacgaggaaatgttggaattggttgagatggagatgagagagttgctttcattctatcaattcgacggtgacaacactccgatcatccgtggttctgctcttggtgcattgaacggtgatgctcaatgggaagataaagtaatggagttgatggaagcttgtgatacttggattcctctgcctccgcgcgaaatcgacaagccgttcttgatgccggttgaggacgtattctcaatcacgggtcgtggtactgttgctacaggtcgtatcgagacaggtattgttaaggttggtgaggaagttcagatcatcggtcttggcgctgctggtaagaaatctgttgttacaggtgttgagatgttccgtaagttattggatcaaggtgaggctggtgataacgttggtttgttgcttcgcggtatcgataagaatgagatcaagcgtggtatggtaatctgccacccgggtcaggttaaagagcattctaagttcaaggctgaggtttatatcttgaagaaagaggaaggtggtcgtcacactccgttccacaacaaatatcgtcctcagttctatatccgtacattggatgtaactggtgagatcactttgccggaaggaactgaaatggtaatgccgggtgataacgtaacgatcgaggttgagttgatctatccggtagcatgtagcgtaggtcttcgtttcgctatccgcgagggtggacgtacagtaggtgcaggccagatcacagaattagagaactaattcaagcattagataatgttatagccagtctttttaagggctggctatttctacggaagtagctcagttggtagagcactggtctccaaaaccaggtgtcgggagttcgagcctctccttccgtgctaaaatctatagattcgatgaaaaagataattacttatattaaggaatcttataacgaacttgtttataaagtttcttggcctacgagagcagagctttccaatagtgcggttgttgttatgtttgcttcccttatcatcgccgcattgatctttgttgttgacggggccttcgaggctgttatgcgtttcttctacaaccaaattttctaatcagttaaggtatgtctgatatccaaaagaaattttatgttctgcgtgccatcagtggcaaggagaacaaggtacgggaatatctagaggctgagctgaagaatacggatctgggagaatatgtatctcaagtcttgattccgactgagaaaacctttacggtacgaaacggtaagaaggtcatgaaagaaagggcttacttgccgggttatgtgctggtcgaggctgctttggtcggtgaggttgctcatcgattgcggaacattccgaatgtgattggtttcttgggtggttctgatacccccgtgccattacgtcctgcggaagtgaatcgtatcttaggtacggttgacgagttgcaggaacaacaagaggatctggatatccagttctatgttggcgagagtgtgaagattacttttggaccgttcagcggtttcacgggtataatcgaagaggtcaacgccgagaaaaagaaacttaaggtgatggttaaggtcttcggacgcaagactccccttgagttgggttatatgcaagttgagaaagaatagtactctggttacgaaaagtgctacctttctgttattgatgttatatatctaaaaaattttagaaacaatggctaaagaagttgctggacaaatcaaattgcagattaaaggaggagcagcaaacccttctcccccagtaggacctgctttgggttctaagggtattaacattatggagttttgcaagcaatttaatgccaagacccaagacaaggctggtaagatattacctgttgtaattacttactatgccgataagtctttcgactttgtcgttaaaactcctcctgtggcaatccagttgttggaagctactaagaagaagagcggttccgctcaacctaaccgtgctaagatcgctgagatcacatgggagcaggtgaaagctatcgctgaagacaaattagtcgatctaaactgctttactgtcgagtcggccatgagaatggttgcgggaacagccagaagtatgggtatcactgttaaagggacattcccgggtaataattaataaacttcaattgagatgagtaaacttacaaagaatcaaaagttggctttgggcaagattgaagctgggaaagcatatacattgaaagaagcttcagctttagtgaaggaaattactacaactaagtttgacgcatccgtagatgttgatgtccgtttaggtgttgacccccgtaaggccaatcaaatggtgagaggcgtggtttcattgcctcacggaactggtaagcaggttagggttctcgcattatgtactccggacaaggaagctgaagctactgccgctggagctgactatgttggattggatgagtatattaataagattaaaggcggttggactgaaattgatgttatcatcactatgccttctatcatgggtaagatcggtgctcttggtcgcgtattaggccctcgtggtttgatgcctaacccaaagagtggtacggttaccaatgagatcggaaatgcggtgaaggaggttaagcaaggtaagatcgactttaaggtagataagagcggtatcgttcacacatctgttggtaaggtgtctttcactccggaacagattcgtgacaatgctaaggagtttatttcaactttgatcaagttgaaacctactgcggctaaaggtgcgtatataaagagtatttatctttctagtactatgagtgcgggtattaaaattgaccccaaatcagttgaagaaaactaaaaaacaattgaacaatgagaaaggaagataaaggaactgttataggtcaattaactgaaacattaaaggaatatcctaatttctatttgacggatatcgaggcgttggacgctgagaaaaccagcaaattgagaagagagtgtttcaagcgtgaggttaagttagtcgttgtaaagaataacttgcttaagaaagcgttggagaacattgaaggtgacttctctgatcttaacgtagctttgaaaggcaatacggctgtgatgttctcacaagtcgctaatgctcccgctcgcctgattaaggattttactaaggacgctaaaaaaggtgtagtcgctaaaccggctttgaaggctgcttacgtacaagaaagcttctatgtaggtgctgagaatcttgaggcattagtaaatatcaagagcaaaaacgaacttattgccgatgttatcgcattgttggaatctccggcgaagaacgttatctctgctcttcagtcatcaggacaaactatccatggtctgttgaagactttggaagaaagataatttttcattaaaacattacacagataaataatcatttaaatcatacaaaaatggcagatttgaaagcttttgcagaacaattagtaaacttgaccgttaaagaagttagcgaattagctactatccttaaagaagagtacggtatcgaacctgctgctgcagctgttgctgttgctggtcctgctgctggtggtgctgctgccgctgcagaagagaagacttctttcgatgttgtattgaaagcagctggtgctaataaattagctatcgttaagttagttaaagaattaacaggtcttggcttgaaagaggctaaggatatggtagatagcgctcctagtgcaattaaggaaggtatcgctaaagctgatgctgaggcattgaagaaacagttggaagaggctggagctgaagttgagcttaaatagtatttataacctggtttccaggtgatttggttaagagtctccgactacgaagactcttaacctttttgtgtctataatttcaataagttcaataaattccttactagatgtcttcaacagctgaaaaccaaagagttaattttgcttcgataaagaatcagttcccgtatccggactttctcgaagttcaattgaagtcgttccaagactttcttcaacttgacactcctcctgaaaagagaaagaaggagggattgtataaggtatttgccgagaatttcccgattgcggatacccgtaacaattttgtgttggagttcttagattactatatagatccgcctcgttactgtatcgatgagtgtatcgctcgcgggttaacctatagcgtgcctttaaaagcgaagttaaaactgtactgtacggacccggatcatgaggacttcgatacggtgatccaagatgtatacttaggtccgatcccgtatatgacggacagaggtactttcgtgatcaacggcgccgagcgtgttgtcgtgtctcagctgcaccgttctccgggcgtattcttcggacaaagcacgcacgcaaacggaacgaagttgtactccgcacgtattatcccgttcaaggggtcatggatcgagttcgctacggacatcaacaatgtgatgtacgcttacatcgaccgtaaaaagaaattgcctgtaactactcttttgagagctattggttttgaaagcgatagagatattcttgaaatcttcaaccttgcggaagaggtgaaggtaacgaaagcaaacctgaagaagtttatcggacgtaagctggccgctcgtgttttgaagacttgggtggaggatttcgtagatgaggataccggtgaggtggtttctattgaacgtaacgatgtaatcatcgaccgtgagtctgtattggatagtgacaatatcgaggctatcttggattcaggcacgcaaaatattttgttgcatcgtgaggaccagaatctgtccgactatgctatcatatataatacgctccagaaagacccgagtaactccgagaaggaagctgtgttgtatatctacagacagttgagaaatgcggaaccggctgatgaggctagcgcacgcgaggttatcacgaacctgttcttctcagagaaacgttatgatctgggtgaggtgggacgttacaggatcaacaagaagttaggccttactacaagcgctgatgttaaggtcttgactaaagaagatattatcgagatcatcaagtacctgatcgagttgatcaactcgaaggctatcgtggatgatatcgaccacttaagcaaccgtcgtgtacgtacggttggcgagcaattgtataaccagttcggtattggtttggctcgtatgtcacgtacagttcgtgaacgtatgaacgttcgcgataatgaggtgtttactccgattgatttgatcaatgcgaagacgatttcttccgtggttaactctttcttcggaacgaatgccttgtctcagttcatggaccagacgaacccgttggcggagatcacgcacaagcgtcgtttatcagccctaggtccgggaggtttgtctagagagcgtgccggattcgaggttcgtgacgttcactatacgcactatggtcgtctttgtccgattgagaccccggaaggtccgaacattggtttgatctcttctttatgtgtatacgctaagatcaacgatcttggtttcatctcgactccgtaccgtaaggtggcagatggaaaggtcgacttctctgaggaaggcttgcaatactacacggcggaggaagaggaagagttgacaatcgctcaaggtaacgctccattggatgataacggtaagtttatccgcgataaggtgaaggctcgtttcgaggctgacttccctgttgtccctccttctgagattgacttgatggacgtggctccgcagcagatcgcttctatcgcggcttcactgatcccgttcttggaacatgatgacgctaaccgtgcgttgatgggatctaacatgatgcgtcaggcggttcctttgttgcgtacggacgctccgatcgttggtaccggtatcgaggcgcaggttgctcgtgactctcgtactcagattatggctgagcgtgagggcgaggttgtgttcgttgatgctacttgtatcaagattaaatatgaccgcacggaggacgaggaattcgttagcttcgaggatgcggttaagacatataatatcccgaaatggcgtaagaccaaccaaagtacgacagtcgatttgaaaccgacctgtcatcgcggacaacgtgtgaaagccggcgatatccttaccgagggttactcaacccagaaaggcgagcttgccttgggacgtaacgtgaaggtggcttacatgccttggaagggttataactatgaggatgctatcgtgttgaacgagcgtatggttcgtgaggacttctttacgtctgtccacgttgacgaatacatccttgaggtacgtgagacgaagcgtggtatggaggaattgacttccgatatccctaacgtcagcgaagaggctaccaaggatttggatgagagaggtatcgttcgtgtaggtgctcgcatcgagccgggtgatatcttgatcggtaagatcactccgaaaggtgagtctgatccatctccggaggaaaagttgttgcgtgctatcttcggtgataaggcgggtgatgtgaaggatgcttccttgaaggctactccgtctttgcgcggtgtggttatcgagaccgctttgttctcgaaggctgtcaagaaacgtaaatccagattgactgataaggcgatcttgccgaagttggacgaggaatacgaagaaaagatggctagcttgaagactttgttagttgataagttgttagtgcttacaaacggcaaggtttctcaaggtgttaaagactatatgaatacggagattatcgctaagggtgctaagtttacccgcaaatctctggaagaattggattataactccatccaagtaagcaagtggacggcagacgctcagaagaatgagttgatcaagcaggttatcttgaattatttgaagaagtacaaggagcttgacgctgagttgagacgtaagaagttcgacttgacgatcggtgatgagctgccgacaggtatcgtacagatggctaaggtttatatcgccaagaaacgtaagattcaggtaggtgataagatggccggtcgccacggtaacaagggtatcgtatcaaagatcgttcgtcaggaggatatgccgttcttggaagacggtactccggtggatatctgcttgaacccgctgggtgtgccttctcgtatgaacttgggacagattttcgaggccgtgttgggttgggccggacgtgagttggacgttaagttcgctactccgatcttcgatggtgcgactttggatgatttgaacgaatggacagacaaagctggtattcctcgctacggtaagtcttacttgtatgatggtggtactggtgagcgtttcgaccaacctgctacggtgggtgtgacttacttcttgaagttgggccacatggttgacgataagatgcatgcccgttcaatcggtccgtactctttgattacgcaacagccgttaggtggtaaggcacagttcggtggtcagcgtttcggagagatggaggtttgggcactggaagccttcggtgccgctcatgttcttcaggaaattcttacgattaagtctgatgacgttgtaggacgttcgaaggcttatgaggcgatcgtgaagggtgatccgatgccacagccgggtatccctgaatctctgaatgtattattgcacgagttgagaggacttggtttgagtttcactctggattaattcaataacaataaagaagtaggtgggctacggcccgtctactttatctattgataactctttataaataaataatatggcctttagaaaagaaaacaagataaagagtaacttttcaaaaataaccatcggtctggcatcccctgaggagatcctagagaactccagcggtgaggttttgaaaccggaaacaattaactatcgtacgtataagcctgagcgtgacggtttgttctgtgagcgtatctttggtccgatcaaggactatgagtgccattgcggtaagtacaagcgtatccgttacaaaggtattgtctgcgatcgttgtggagtggaagttacggaaaagaaagttcgtcgtgaacgtatgggacacatccatttggtggttcctgttgcccatatttggtatttccgttctttgcctaataaaatcggttacttgctaggtcttcctaccaagaaactggattccatcatctattacgaacgctacgtcgtgatccagccgggttgcgtagacacggtcggtgagttagacctattatctgaggaggaatatctggatattttggatagccttccaagagaaaatcaattgctagaggatacggatccgaataagttcatcgctaagatcggcgctgaggctgtttatgatctgttggctcgcttggacttggattctctttcttatgagttgcgtcaccgtgcgagcacggacacatctcaacagagaaagaacgaggccttgaaacgccttcaggtagttgagtcttttcgtgcgtccagaggtcgtaacaaaccggaatggatgatcatgaaagtgatcccggtgatccctcccgaactgcgtccgttggttccgttggacggtggccgtttcgctacttctgacttgaatgatttatatcgtcgtgttattatccgtaataaccgtttgaaacgattgatcgatattaaggctccggaagtgatcttacgtaatgagaaacgtatgcttcaggaggccgtggactctttgtttgacaactctcgtaaatcgagcgctgttaagacagacgccaatcgtccgttgaagtccttgtccgacagtttgaaaggtaaacaaggtcgtttccgtcagaacttgttgggtaagcgtgttgactactccgctcgttcggttattgtcgtaggtccggaattaaagatgcacgagtgcggtttgccgaagaatatggctgccgagctttataagcctttcgttatccgtaaattgatcgaacgcggtatcgtgaagacggtgaaatctgccaagaagatcgttgaccgtaaggaaccggttgtttgggatattttggagtacgtaatgaaaggtcacccggtattattgaaccgtgccccgacattgcaccgtttgggtatccaagcgttccagccgaaattgatcgagggtaaggctatccagttgcacccgttggcatgtacggcattcaacgccgacttcgacggtgaccagatggctgttcacttgccgttaggtaatgaggctgttttggaagctcaaatgttgatgttggcttcacacaatatcttgaaccctgcgaatggtgctcctattaccgtaccttctcaggatatggtgcttggtttgtattatattaccaagttgcgcaagggtacacaaggcgaaggtttgactttctatggtccggaagaggctacgatcgcttacaatgagaagaagttggatatccatgctccgatccatgtttacgtggaggatttggatgcgaacggtaacttggtgaagacgatggtagagacttctgtaggtcgtttgatggtaaatgagtttgttccgaaagagattggttatgtaaacgaggtgttgggcaagaagtctcttcgtgacatcatcggtcgggtaatcaaggcttgtggtgtggctcgtaccgctcagttcttggacgatatcaagaacttgggttactatatggcattcaagggtggtttgtccttcaacttagcggacgttctgatcccgcctgaaaaggatgagttggttcagaagggatacgatgaggttgagcagatcatggctaactataatatgggtttcattaccaacaacgagcgttataaccagattatcgatacttggacacacgttaatagtaacttgtctaatatcttgattaagcaattgacggcggataacgatggattcaactcaatctatatgatgatggattccggtgcccgtggttctaaggagcagattcgtcagttgtccggtatgcgtggtttgatggcgaaaccgcagaagagtggtgcagaaggtggtcagattatcgagaacccgatcctttctaactttaaggaaggtttgtccgtgttggagtactttatctctactcacggtgctcgtaaaggtttggccgataccgctttgaagactgccgacgccggctacttgactcgtcgtttggttgacgtctctcacgacgtgatcgtaaacgaggaagactgtggtacattgcgtggcttggtttgtacggaattgaagaataacgaggaggtgatcgcttccttgtatgagagaatcttaggtcgtgtatctgttcacgatgtgatccatccgattacgggcgaggttatcgttcgttccggtgaggaaatccgtgaggatgccgctaaggcaatccaagactctccgatcgagagcgtcgagattcgttccgtattgacttgtgagtctaagaagggtgtctgcgctaagtgctatggacgtaacttggctacgaaccgcatggttcagaagggtgaggttgtcggtgtaatcgccgcgcagtctatcggtgagccgggtacacagttgacgttgcgtacattccacgtcggtggtatcgcatccaacatcgctacagagaatagtattacatctaaatatgatggtattttagagatcgacgagcttcgtgctgttgaggcggtagacgaggtgagcggaaagaaacatttggtagtagtaagccgtttggctgaaatgcgcattgttgatccgaacacgaagattgtgttgttgactcataatataccttatggttctaagttgttcttcaacaacggtgactcaattaagaagggtgacgtgatcatcgagtgggacccgttcaatgccgtaatcgtgtcagaggtttccggtaagatcgagttcgagagtttggtagagaacgtgacttacaaggttgagagtgatgagactaccggtttgaaggagaagatcatcatcgagtctaaggataagacgaaggctccggccgctcatatcgtggatgagaatggtaattacttgaagaactactctttgccgttgggcgctcacgtcgtgaaagacaatggtgatgtagtgaaagctggtgaggttttggttaagatccctcgtgccgtaggtaaggccggtgatatcaccggtggtcttcctcgtgtaaccgagttgttcgaggctcgtaacccgtctaaccctgctgtcgtatctgagatcgacggagaggtaggattcggtaagatcaaacgtggtaaccgcgagatcaccgtaacgtctaagttgggtgaggttaagaaatatatggttcctctgtctaaacaattattggttcaggagaacgactatatccgtgcgggtatgccgctatcagacggtgctaccactccttcggatatcttggcgatcaaaggtccgacggctgtacaggaatatatcgtgaatgaggttcaggatgtataccgtctacagggtgtgaagatcaacgataagcacttcgaggttatcgttcgtcagatgatgcgtaaggtagaggtggttgatccgggagatactcgcttcttggagcagcagattgttgataagttggaggtaatggacgagaacgatcgtatctggggcaagaaagttgttaccgatccgggagattctcagacattgcaggccggacagatcgtgactgcacgtaagttgagagatgagaatagtatgttgaaacgccgtgatcttaagttggtcgaggtacgtgacgctattccggctacagccaaccagatccttcaaggtatcacacgtgccgctttgcagacgaacagctttatgtccgccgcatctttccaagagacgacgaaagtattgaacgaggctgctatcaacgggaaggtagatcgtttggaaggtttgaaagagaacgttatctgtggtcacttgattcctgccggtaccggtcagcgtgagtttgataagctgatcgtaggcgcaaaggatgagttcgatcgtatcttcgctaatcgcaagaacgtggttgatttcaatgccatggacaaagatgatgaagaataggaacgtttaataaactataaagaaaggccggcagagcaatctgtcggccttttttgttcttccttatttgcttaataaatggataaactttatttttgcgaggtaacaaagaccatagataaatactgagacatataagaaacatataataatcaatatcatgaagagaattttactttgtttaatggtggctttatttgccactggttgcttattcgctaaaaacaacgatgagaaaatgaatgtaatgtcttataacatccgttacgataatttgggtgataaggataatcaatggaaattcagaagagatttcgctgctgatttagtgaaattctatgaggcggatgtgttcggtgcgcaagaggtcttgaataatcagctgaatgatttgcttaatcgtttaccggaatacgcttatgtgggtgttggtcgtgaggatggcaagacgaaaggggagtacgctccgattttctatcgtaaggatcgtttctccgttgataaaagcggtaatttctggttagccgaagatataaatgccattggtaagaaaggttgggacgccgcatgcgagcgcgtagctacttgggcgatcttgaaagataagaatacgggaaagaaattcttcttcttgaatacgcacttggatcatatggggaaagtggctcgtcatgaaggagcttctttggtgctggagcaagcgaagaaattatccgagaatttacctataatcgtgactggcgatttcaatgccgtgccttctgatgagccgatacaagtattgactaatccgagtgatcctcgtcatttgactcattcccgcacgatcgcagggtttacttacggcccgaaatggacattccatgattttggaaagatcccttacgacaagcgtgaatggatcgattatatcttcgtgaaagggaatatcaaagtattgcgtcatggtgtattgactgaaacgttgaataatctgttcccatccgaccattgtccggtaatcagtacgttgatactcgaataaaaaagctttgtgtgtatggggaaagtagacgtattgaaggaaactaccccgctttcatcagaagattgcttcttggtcatgcaacgcccgaaatcggggtttaattttccgttacatgtacacatggaatttgagttgaactatctggagaatgccgctggcgctatccggatagttggcgattcggtcgaggaaatcgatgatctggatttggtgttgatcgcgggaggaacgaagcatgcttactcgaaccataagtgtccgtgtaatgggatctttgagataacgatacaatttcataaatcgttatttgatagcttgatcaatagacggcatttcaagaccatgaaggatatgtttgataacgcttccagtggtcttgttttcagccgggaaatgatacttggcattcaagataaattaagaatgttgtcgaacgataacaagccggattctttcaagaacctgttgcgtttggtcgagattcttaagattctatctttggataaagcagcccgtcggttgaatgccgtgaacacggtaaagaactataataataacgataccgatcgtttagatagtatcatgttatatttacacgaaaataatcaaaaacgtatcaccttgtcggaagtggctaagttaacaaatatgagcgatgcctcattgatgcgtttcttgaagaagtggacgggaaagacatttatcgataacttgaacgagatccgggtagccgaggcggtatgccgtttgaccgatacaagtgacagtatttctgaaatatgttacaggtgcggttttaataatctatcgaatttcaaccgggtattcaaacggcgtagggggagtacccctacagagtacagggagaaatattcccgttcgaggtttataatttgaaacatgatttaaagcatgtttacattgatttgtgtcaagtgttgatgatatagtattatttattgcacatatagtatttggtggtctttgctaaagcccttacttttgtaaagttcaagtgaaagagattagcacttagacaaaacaaaccttaactaaaacgccaaaaccaattatatcaaacacaaaaggtatttttacattggtctaaagaattgagaattaaaaacacaactagaaaacgactgcctgagaaggtagtcgtttttgcatttatagtcttcaaccactttgtaacccggaataaatatgtatatttgtcttcgcaatttttaatcaccataaatttaaaagaagaaagtatggaaaacaacaaacctgccaataacgagattcagatcgagttatctgaagaaatggcacaagggacttacgccaatttggctattatatctcattcaagctctgaatttatcctagatttcatccgggtggttccgggagctcctaaggcacaagtcaaaagtcgcgtaatcttaactccggataacgctcaacgtttgttattcgctttgcaagacaatatcaagaaatttggggagcaacttcaagcaggaaataataataacaaaacagctaattttgaggacttcgcaggtccgacaggagaggcttaatagatttgttttcagccatagaaagagtacttttctacaagagtaggggagtactcttttattgttgggatggctcgtttacattgaaaaaccttgatgcctattcttagatgcttacaatgggcattctaaggtgttaagaatgcctgttataaacacctaagaatgcccatcgtaaagaataccctatctctctatcctaaagattagataatcccatcaatattttcttcaatacggtttgcgcagagatctcacggttcgcggcctcggggattacgatactttgcggactctctatcacgtcatcggtaacgatcatattgcggcgaaccggcaagcaatgcatgaaataagcgttattcgtaagtgccattttctctgcgtctacggtccagctacgatctgtgctgattacttgtccgtaattcggatctttataagcggaccagttctttgcgtaaatgaaatccgctccttcaaaagccttcttctgatcgtattccactttagcgttgcttacgaatctaggatcaagctcataaccttccggatgagtgataacaaactcataatctgtagcgttcatccattcggcaaagctgtttggaacggcttgcggcaatgatttcggatgaggagcccaagtcatgactaccttcggacgagctgttttcttatattcctctatcgtgatcaagtcggcgaaactttgcaacggatggcgtgtcgccgcttccatgctaaataccggccggccggaatgctcgatgaactgactcaatatcttttcgttataatcatcttctttattctcaaagcgtgcgaaagaacggaccccgatcacatcgcagtaacagcccattacaggaacagcttccagcaaatgctccggtttatcaccatccatgataacacctcgctctgtttccagcttccatgcaccttggttaacgtccaaaacgatcgtgttcatacctaagttcatggcagccttttgggtgcttaagcgggtacgtaggcttgagttgaaaaatatcatcaacaacgtcttgttttttcccagttcactaaactggaaacgatctttcttgatctcgaaagcttcattaagcgcttgtttcaagtcacctaaatcctgtacgcaagtgaaatgtctcatatctgttacaataatattttgttaaaggcaaagataatgactacttgtcaattatcctttagaaagaccaaggaattgtttaagagatcgtatccggaggtgttatgggtagtttgaaactgaaggtagaacctttcccttcctccgagttcacccagatggtacctcccatggcggtgaccagacctttacagatcgaaagccctaacccggtgcccggctggaattcgttcaattgcacgaatcgttcgaagatatgtcccagtttgtccttcgggatgccgttacctgtatcggacacgtaaaattgcacgctgaccggatacaacgattggtatccgaaatgaatttctcctttctccgtatatcggagggcgttagaaagtagttttttcaagataagcataagcttatgtttatccgtgtgaagagatacgtttggagaatcatccaagattaaccgtacgtttttggatatgcggggagaggcgtattcgtatacatcgtgcatgatagcgagcggatttacatcctcatatgaccaattgatcgtattggactcgattctggacatctcgagcgtgtcattgattaattcgagcaaagccgtgttattttctttaatcatggaaatatactgttcacgcatttccggatcatcttccagtcctaacatatcggagaagccgacgatggcatttagcggagtccggatctcgtgcgtcatatttgccagaaacgtagatttcaatagggaaagatccttggatttctgatgatccgcgatagctagctcgtcgttttccttttcgataatgctacctataatgacatgtggggtgccgctttcatcaatatccatgcttttacccgatatttcatacatcttataagtcccgtcttgattcctcaggtggaaggtgacgttgtgagacgataatttctcgtcccggattttattgaacagatagaagaaatccaaactatcctctggcttacgtacggatgataaagccctgcatataaacctgtttttatctaatagagtattggtcgtgccgtagaattgaaaacagcggttacaatgctttttgtcgcaagtggagaaacggtcgaagctgaatgagtaagcggctaatttaccgtcttccaacgcttgccgcatcaatatccggctctcgttcaattgtcccatcaatagtttattttccctgtcagtttctttttctccctgctgcgtaagccaaagcgtatacccgctaagcccctgttcatcggtatagatgggttctactttaaacgtgacgggctcttcgcatataattgcgtcaccttttcttaaagatgacttcaaggaatcggttagtacgatgttattaaatagatgttctataataaagtcatgcttatccgccaaggaaaaatgagcgaacatcgccttattcaagtctatcagatttccttccgtatcatagatagcccctcctaaaggacaggaatagaatgtatttgaaactaaagtattgaaaatatttgaatctattactgttgacattattcgtttagatttaagtgttgttctagaagaaagagacaggcgagttcctatattctcgtctgcccgtctccttctatgatgtatttataagtcgttaattcaggaagcgccatcggtccccgggcatgtagcttttgggtactgattccgatctccgccccgaatccgaattgggccccatcagtaaaggcggtagatacatttgcgtatacgcaagcggcatctaccaattgctggaagcgccggatagtttccggatcttcgctgattatgctttcgctatgttttgaactgtaccgggcgatatgtgatagagcctcgtctaaagaggatacggtacggatactcattttgtaatcgaggaactcggtaccgaaactgttttcgttagcctgttgtaaaagcgtctccggataatgttcggatagagcggcataagccggttcgtccgcataaatgattacgttgctgtccggaagctttccacagatatacggaagatcagatagacgttctcggtggatgattaagcaatccaaggcattacatacgctgaccctccgtgtctttgcgttatttacgatctcacgtcccttgcctttatctccggagcgatcaaaataggtatgacagataccggcacccgtctcgatcaccggaactttcgcgtgttcccggacgaagtgaatcaaggaactgcttccacgaggaatgattaagtcaaccaagccgaccgctcccagtaattccgccgtagcctctcgatccggaggtagtaaagtgcataccgccggatttataccctgacgctccaatacagaatggatgatgcgtaccaaggctcggttagagaagtccgcatccgatccaccctttagcacgcaaacattaccgcttcggaaacataaggaaaaaacatcgaaggtaacattcggacgagcctcatagatcacaccgatcaccccgaaaggcacggttacttttcggataaccattccgttcgggcgggtagtctcgctcaagaccttatttaatggagaaggtaatgtcgatacattctccatatcggcggcgataccttgtagcctttcctctgtcaatttcagccggtcgtatttcgggttcgcggggtccatacgttccagatcttggcgattcgcggcgagtacctcctccgtatgagtccgtagaacctgcgctgtctcctttaagatcccgataatcgtttgatccgatagcgttatcaattgtttagccgcatccgatgcctgtcgcagcatatcttttacattcatactttttaatccagatatagataatcataatgtataagcggttttaaatcccgttgccctatttgcttacgtgcttcctcgctgtcataggcggtacagcctacgccgatttgcacgccttcctcattcattatctttacgatatcatctttttcgaaatcaccctcgatgcgggttactccaaccaataatacgctagtcgctttcggggcggtcaatgcctcctcggctcctttattgatatgtatttcccctttggcgaaaccctcggagtgggcgatccatttctttacgctgctgacgggtttcgaggccggaatgaaacgggtgcagaccgtgtcgctatccaccgccaataacatcggaaggatattatcctttttgccgttggcgatgataaccgcaataccttcgtccgccactttttgggcgatatgacatttcgtcaacatacctccccgtccaaaggatgatttgctagtctgtacatattccgacaaatctgttttcccacattcgatttcccggatcacggaactatccgggtccgacggatttccattgtaaatcccgtctatattactgagaatcaccaaggcatccattcccatcatcgtagcgatcaagccggataactcatcattatccgtgaacatcagctcggttacggatatcgtatcattctcatttacgatggggatcaccttgttttcaagcattacctccatgcaatgcttctggttcaggtaatgcgtacgactcccgaaattctcttttgtagtaagcacttgcccgcaagtcatgccatgctcccggaataactcgtaataccggttgatcaacttggcctgtcctaccgccgaatacagttgccgggctgatacgggatccagctttttgccggcctttatctcgcttcgtccagaagccacggcaccggaggagatcaagacgatctccataccttgccggtgcaagtccgctacttggtcaaccaacgcggacatgcgggtgatatctagcgtcccatccttgcgggtcaggacattgcttcctatttttacagcgatccttttcaagaaagttatgatttattatttattatctttatcccggatctctacccgtcggatctttccgctgattgttttcggcagttcgtccacgaattcgacaacacggggatatttgtaaggagcggtgacacgtttcacgtgattttgcaattctttgaccaaggcatcacacgctttatccttataatccttcgccaatacgatcgtggcctttactacctgtccgcggatctcgtcggggacaccggtgatagcacattccactaccgcagggtgagtcatcaaggcactttccacctcgaacggcccgatacgatagccggaactcttgatcacgtcgtccgcgcggccaacgaaccataagtaaccatcctcgtcacgccaagccacgtctcccgtgtaatacaggccatcgtgccaagcttcccgggtacgttctgcgtcccggtaatattccttgaataacccgataggcttgccatttgttgtgtggatcacgatctgtccttgctcgccatcctccgcacggcttccgtccggacgcaataaatcgacatcgtactgcgggttgggaacacccatagagcccggtttcggctccatccacgggaaagtggcgactgtcagcgtagtctctgtctggccgaagccttccatcaatttaatgccggtcaacttatagaacgtgtcgaacacggcggggttcaaggcctcgccggcgatcgtacaatattgtaaagatgataaatcgtatttagtcatatcctcacgaattaagaaacggaagatcgtaggaggagcgcaaagcgaggtgatccggtaatcctgtatcatctgcaacatatcagcaggcgtgaatttctcgtggtcgtaaacaaatacggtcgctccggcgatccattgcccatatagcttaccccaaactgccttgccccagcccgtatccgcgatcgtcaggtgaaggctgtccttatgcaagttgtgccagaaactaccggtcacgatatgccccagcggatacgtaaagtcgtgggccaccattttcgggtttccagtcgtaccggaggtgaaatacatcaaagagatatcgtcattgctatttgggtgagacgggcggacgaaaggagcggcgttttggataccctgttggaaatcctcgaaaccttccggtatttccggccctacggatacaacactttttacggtcggtgagtccggcaaagcctctatgatatgtttcgttatcacttcctctccggcgcaaacgatcatcttgatatcggcggcattcgcacgataaacgatatctttcttggtcagtaagtgtgtagccggtatcacgacagcccctaatttatgcaatgcgatgatagagaaccagaactcataacggcgtttgagtatcagcatcaccatatcgccatgtccgatccccaaggattggaaataagaagccgtctggtccgtataccgtttcaagtcggcaaacgtaaaatcaatatgctctccatgatcgtttgtccaacataacgctttcttatcaggttcttcctccgcccaagcgtctaccacatcatatccgaagttgaagttctccggaaccttgatcttgaagtttttaataaaatcttcttgcgactcaaacgtcgttttatctataaatctttctaacatgctgttgatcgtttataaaatgacggccaagaaactgaccttttccccatccagcgctttcataccgtgaggaagctctgagttaaaataaatactatcaccttcttctaagataagatctttattgttgatctgtagtaacagacgtccttttaataccatattgtattcttgccccggatgggaattgagatacatcggctcatcctctggtttgggatgtacggttaccaagaaggggtccgctttacgtccgacgaaaccggcggccaatgattggtacttataggctttcgtacgctctacggcaacaccttttccgttacgagtaataaagtacgtactcattttaggctcgtcgccaaacatcaacgtggttaattctacgccataagcctgtgagatctggtgcaatacgctaacggaaatatcaaccgtgccgctttccagcagcaaatattgctcagtcgtgaggttgcagacctttgccatttcttccggcgtaatctccagtgcgtcccgtaatccggccagacgctctgcgatttgttgtatctgttcgttcattttgctgaagttattgtattatgtcgctccaaagataggaataaaaagcaaaaagaaggtgaaagcccttgttttcttttctaattaacaggtatggcttgtttttaatacaaatgacgcagataatacggataagaatagcaaatccgtgtcatctgcgtctgaaagataagcatctaatacttattcagcatttttctttagccattctaaccggcgctgatccgggaggtgttttaccttgaaatgctcgaatatcacattaaatcctttcccgtcgggacaagcggccataaacccgacttgtacggggatattgtcttgtagccaagcgttacgcataagggttccttatcatcgaatgagtagaagatctccacggcgtccaatctccggacagcttttatccatacataagggatcgctttgtctaaggtgataacgctccagtcggaggtcttatgcgtaacgaccgcgcttaggttgtatttaccatccacgaactctataccggcttttatataattttcatgattgatgcgaagcatcaggccggcttggtcaaaacgctgcttgtaatcgccggttatcttgactttcacttcgaattcacccccataagtcgcataataaaaaggagcgtcatctaccgtaaacccgtaatgggaaatcctccaatagtcactttggggagtgacctgcatggaaagtgacttgtctttaatctcccattgctccggctcgttgaaccattgcatcttatctaatgattgcgccccgcaaaattgcaaagaggcgacaataacaaaactcagtaatactaattttctcattttacttcttatttcttattttgattctttctattcccgtaagaagttaatgttattaaccttacctccgcaaaggtaacgtgttattatagatcgcgcaatgattctgtgattttatctaggaaggaaaagtaagggttaatgtgttttcgtctattcgtatttgataacctcgaccgggcagctttcggcagcctctttaatacccgcctcgaaatcatcgaaattaactccttcgtttacacgtgaacgatctgtaacagtgaatacttccgggcaaatgccctcgcatgtaccgcaagcgatgcaatcctcttcaatccaaactcttttaattgccataattttattcctttaagatgattaatatgttaatgtaacaaacaactttcgcggattgttttcgggagaggtcttttagatcattgtatagaccgtgaaatgagcttatctttggttgatatatattaacgtttacacgccactgttttaaaataaatttgctacgtttacagcagaaagtttcattgaataaccatttaaaaaatctgaagtattatggataatgctatttttagatttcctaaacccattaatgagccggtaaaagcgtatgctcccggatcaagtgaaaaagcatccttaaagaaagcgttggcgcagataagttccgaggaatgggatatacctctggtaattggcggaaaagagatccgtacgggtaataccggtaaggtcgttatgcctcatgatcatcatcatgtattggctacttatcataaggcgggcgagaaagaagtacaaatggctatcgacgccgccatgaaagcgcataaggaatggtcagaacttccatgggtggaacgtgcgtctattatgcttcgtgtagctgagttgttggctacgaaatatcgttatatcctgaacgcttcggttatgttgggacagagcaagaatccgttccaagcggagatcgacgctccctgcgaattgatcgatttcttgcgtttcagtaccttctacgctagtcaagtatatgccgatcaaccctattccgagacgggtatattgaatcgtatggaataccgagccttggaaggtttcgtgttctcgctcacgccgtttaattttacgtcgatcgcttccaacctgaatatggctccggctatgatgggtaacgtggcggtatggaaaccgtctactacggcgatccattcgaactatttcttgatgaaggttttccaagaggccggcttgcccgatggcgtagtgaatttcatcccgggacagggtagcgtgatcggtaaggtgattacgggtagccgtgatttggcgggattccattttacgggctctacctctacgttcaataccttgtggcgtcagatcggagagaacttggggcattataaatcttatccgaagatcgtaggcgagacaggtggcaagaactttatcttcgctcatccttccgctccggcgttggatgtggctaccgctatcgtacgcggcgcgttcgagtatcaggggcagaagtgctcggcgggttcccgggcctatatcccggcttctctctggaaagaggtgaaagattacgtgggcgatatgctgaaagagatcaagatgggtgacgtgcaggatttcacgaactttgtcaatgccgtgatcgatgaggcttcgttcgataacatcatgagttatatcgattatgcgaaacagtctccggacgcagaggttctttttggtggtaacggggacaaatctgtaggttatttcgtggagccaacggttatccagaccacggacccgatgttcaagagcatggtagaggaaatcttcgggccggtgattacgatctacgtatatgacgacgctaaatatgaggagactttggaactttgtgatcgtacttctccgtacggattgacgggttctattttcgcccgtgatcgctatgcgatcgataaggcattcaataccttgcgctattcggccggtaatttctatatcaatgataaaccgaccggcgccgtgatcgcccagcaaccgttcggcggttcccgtgcgtccggaacgaatgacaaggccggtggcccgctgaacttgattcgttggacgaatcctcgttgtatcaaggaatgtttggttcctccgacgagctacgggtatccgttcttaggtgagaaataattgtcataattaagaaataccaactgattgtgggggagacggggcgtgccccgtctctacgctatgacgttacctttatctacatacaatatgttagactttaacaataccgagatcgctttctcgtcgaagtcgcggggagaactacaaaatgcttactggctttttaatacgataaaatatccttggttggtaaaatgcgctaaagtagccacgagtatagccttgaaaatacatttcccgctggcttgggcggtgaagcctaccttatataaacagttcgttgggggagaaactttacaagactgttccgcagccatcaaccacttgatgaaatacaacgtgaaatcgacgctcgattattcggcggagagcgagcagaccccggagggcatacaggcgactttcgaggaaaccttgcgctcgatagattttgcgaaaggaaatacgaatctggcctatgccgtattcaaaccatccacgatcacgaccgatgagttactggccaaagcttccgagaaacgggaagagcttacgatagacgatgtccggcatttccgcgagttccgcgagcgttttatggcgctttgccaacgggcttacgataacgacgtacgtattttagtggatgcggaggattattgtttccaagatgccattgatgcgttgaccgatgaggcgatgcgtaagttcaacaagaaacgtgcgatcgtattcgctaccttgcaaatgtatcgtcatgaccggatgccttatctgcgtcgtatctacgatgatgccgtggcgaaaggttatattgcgggcgtgaaattcgtgcgcggggcttatatggaagcggagcgtgcccgtgcggcggcgttggattatcccgatccgatttgtaaagataagcaggccacggacgagaattatgatgcggcggtccgtttcaccatggatcatttagatcgttttgagatgtttatgggaactcataatgaggagagtaattataagttggcgaaattgatggacgagaaggggatcgcccgcgatgactcccgtgttttctttgcgcagctattgggaatgagcgataatatttccttcaatttagcccatgcgggatataacgtaaccaaatacgtaccgtacgcctcggtaagggatgtactgccgtatttgatccggcgtgcggaagagaatacttctgtcgcggggcagaccagccgggaactccggatgttggagatggaaatgactaggcggaaagaacataaacctgccgagggcaggtaaagtagtttgtcagcatatttcggggcgtattggtgctggcaaactactttgtctgcctatttttatttactggccttcagtccccggatcacggaagaggtaaaaccggaaagttccatctcatttagacccttgatcgtgattccgcccggagttgttaccttatcgatttccatctccgggttacttttgttctcgagcaataaatcaacggcgcctttcacggtatgcaccacgatctcttgcgcttgtttcggatagaaacccaattccacgccgccttctatcgccgcgcggatataacgcaaggcgaaagcgatgccgctggaagccaatgctgttcctgcgcccatcaaccgttcttctaccaacatggcgttgccaagctcgttgaagatatggatgattagatccgtttgctccttggaggcgttgcgggcggaaacgaaagtcatgctgctcatcacctcgatagccgtgttgggcatgatccggaagatcgtgggagtagccagacaatcgaagtctgtattcttggtcaaataagtattcaacaggtcgaaagtcacgccagccgctacggatacgatgatttgtttctcgaagtcgagcaccgacttaatctcatctataatcatttctacacgccaaggtttaacggcgatgatgatgatatcagcgtttcgtgccgcttccacgttatcatgggtcaagataaagtccggatcgatctttctcatcttctccaaggtctcgtccgattgggcggtacaagtgatatcagaggctttgaacatggttcctttcgctaaacctcgggcgatcgctccaccgatattacccgaaccgataatagatattctcattttgcagataattagttatatattatgttttctgaagaggcaaacttagataaaatatctcaaatacgtacgactttgtagagttagctacggataaaaaacttacatttgcggtcgatacggacttaatactaatataaatatataaaattacatgaaaaagacaattctagtttcaagcatgctattcgctctgactatgtccgctacgatccaagcgcaagacacggagaagaaggtgagtgaggagggattcgtgttcacgaccgtgaaagagaaccccattacatctgttaagaaccaaaatcgtgcgggtacgtgctggtgctactcctcgtactctttcttggagtcggagttgcttcgtatgggaaagggcgagtatgacttatccgagatgtttacggtatataacacctatctggatcgtgccgacgctgctgtgcgtacgcatggggatgtttcgttctcgcaaggtggatctttctatgatgcgctttatggaatggaaacattcggcttggttccggaagaggagatgcgcccgggcatgatgtatgccgatacgttgagtaaccataccgagctttccgccttgacggacgctatggtggccgctatcgccaagggaaagttacgcaaattgcagtctgatgagaataacgccatgttatggaagaaggcggtcgctgcggtacatcagatctacttgggggttcctcctgagaaattcacgtataaagggaaggaatatacaccgaaatctttcttcgagtctacaggtttgaaggcttcggattatgtctcattgacttcttatacgcatcatccgttctatacccagttcccgctagagattcaggataactggcgtcacggtatgtcgtataacttgccgctggatgagtttatggaggtctttgataatgcgattaatacgggttatacgatcgcttggggttccgatgtgagcgaatctggttttactcgtgacggagtggccgttatgcctgatgatgagaaggtacaggagttgagcggttccgatatggctcattggttgaaattgaaaccggaggaaaagaagctgaacacaaaaccgcaacctcagaaatggtgtacccaagcagagcgtcagttggcttacgataattacgagacgacagacgaccatggtatgcagatctacggtatcgccaaggatcaagaggggaacgagtattatatggtaaagaactcttggggaaccaacagcaagtataacggtatttggtatgcttccaaggcgtttgtccgttataagaccatgaatatcgtggttcataaagatgccttgcctaaagcgatcaaagccaagttaggtatcaaataaccgatctgccaaggagggttcaaataaaaactaaaccccgatagcttccggcgatccggtaagtctatcggggtgatctatatatacaaagatgtgctgcctataaatttattggacaagtcttagcgtgtagttaagatctgccgccgctttttgcaacgcgtcgttcatcaaggtcaagttatccccttctactaggaaatagatgacgggttcgccatcactgggaatcaactcgtagattactgcgctagcgtcatcgggagttccgtgctttactttttgtttaccggttgtaatggctttctgaggagctttcttcgccgctccggtacttgaggctactgcttccggtacggtataaagagcatccaactcgaatacgccttcctcgtctgcgttatcttgttgataatacaaggttaagtcataatctacgttcacgctatccggagaagtcagggttcccttatactttttttggataaccggtccctttttaggatcagccttcaaggaatccctcatattcacgggctttgccggttgggtcgccttaacagaatggatcagtggcaaagacggagcgtccggagccgccgacattatggcgaattcttcttcctctacttctacgggtacatccttttgggcttgcttcccgctacatgcggccaaaaatgccatagccgctactgcgataaaatactttttcattaccattatttattttattagtgacgtttggatatataacataaaatcccccacgatttgtttcgtgagggatcatttttaactatttaccgtgaaatatttatttcttggaaggctctaccctgtcatccggatagggagcggtcgggatcgtggaagcgcttccgtctcgtccggcgaaatagtgcggtgacatgatctctacgccagcctcattgaatacgtcctgtatgttttgatgcaggtcggaatagatatctccgagtttatcggcgtcctttatataagcgttgatttgataacagggatagtaatcgcttagttcggtctccaatacgaaaggcttcggctctggcaataccccggtggtctggcgggcggcattgatcaataattgatgaacttgccgccaaggtacgtcgtagccgatcgtaaccgtgctgtggatgattaatccgtattgccgtgcggatacgctataatttgttgtatgggaggacatgataaaggagttcgggatggtcactacctcattcttaggggtacgtaaacgggttacaaacggagtcttctcgatcacgttgccagtcgtctcgtttagttggatacggtcacccaatttaaagggcctcatataagtaatgaccagccctgcgatgatatttccgatcaccgtactggaacccaacgatatgatcaaaccgacaaatacggatatgccttgaaatacccccgagtccgatcccggcagataaggatagatcatggcgatcataaaggcgtatagcaggaaacggatgatattaaacgtcggttgcgcccaatccgggtaaaaacctgatattttcaggttctcgctctctatctcgttggctatgtattggattccttttacgatgtatttgatgcagtaatagatcaccaagatgataaacaagttcggaatataggaggctaccgatttaaagatcatctttaccggctccaacaaataggagaatatcttcaaggctagatcttctgtttgcgggaagatagcgaaaaggatcggtacactgatggttaattggattagtaacacgatccatcgtattacgttggtgaaaaacatcaatacacgtccttggcgatgtgtgttgagaaattcataatcccggatggtaatagatctgagtcggttctgctttaaccagataattttcctgcgtagcttcttaaacagatagttggtcagcttaaacaggaaatattggatgataattacgaggatgaacaataatacccgtttcgctatctgcaagatactatgttgctcccttaactcttgtatcttgttttggataatcggttgatattgttcagcgagggctatacgactgagattttgccatagggcatcttgatcggtgatacttaggataaccttgtctccgtacatgatatccgttacgtattcgctgtcatagatatagatggaatccttcttcaaggaatgcgaggtcccgatctttaccatgatattgaggatgtcctcagcccggtcaaccggggtgcggcctccgcgcttggcgtaaaggtgaaataaggtatccccctccacgactacaggtacgccgggagtcagtgcccgaagggaatcgatacggtttcgttgctcggacctttttagggagtcggcggtagcgttgctgtttttcgtgctttccagctcgtctttcagtaagatctcgtttagtttcatctcttgcaactggagggctagctcctgcatcttgatggaatccttccggtgctgctcatcgagcgaaagcgtatcggttggggtaactggttcctccggatcattgcctaatgtcgtagacaatagttcttcggccttttcccttaattgggcgttggacaccgttggcaggaaactgattcctgccaagatcactaatcgcaataaaaattgtttcatcgaatcgtggattaactatttaccaccggccggaagatgttccagccagtatttagccattgtcttacgtaggtgaagagttgttccttccctttcgttgatgctatggctacgcatcgggtaactgatttgcgtaaacatctttccgttcttgatcaacttgttcaccagcatctcgcaattttggtaatgcacgttatcatctcccgtaccatgaataagcagcagattaccttccagtccctcggcataggtaatcggggaacctttgtggtagccttccggattgttctgcggagtattcatgtaacgttcttggtagatcgtgtcgtataaacgttggtcggctacaaaagcgatcgctataccagtatggaatattttcggataacggaacatgcagtttaaggtctggctaccaccaccgctccatccggtaataccgatcctgttggcatcgataaacggatattgacgggtcatatccagaatacccctgctctggtcttcggaagcgaaagtacccacttccccgtaaatacatttccgccattcacgtccacggggagtattcgcaccccggttctcgatacttaccacgatataaccttggttcgccatatattgttgccataaatctccgttaccccatacatcttgtacggtggcgctcgccggctcgccgtatacctctatgataaccgggtatttcttggatgcgtcgaaatcgacaggttttatcatccatgcgtccaaggttagattgccggacttgaccttgataaattctttcgggtttaatcctaaggcggcgtattggtccttggcttgggcattatcctcaagcatgcgtacggattgatgtttcgggaaagaaaccatgtcgataacggatggggtagaggcgttactatacgtatgtatggcccatttgccggtgggtgacatattgtagcggtgctgtccggattgttccatggggcttacacgctccacttccccattgccgaatgctttagcccggtacaagtaacgttgggtgaaattgtccggggaggcgatgaaatagacccagcccttttgtagatcggtcccgaccggcgagatataatcaaaatcacctttggtgatgggttgtatctcttttccgtcccggcttatccggtataagtgtcgccagccactacgctcgctttcccatgtgaaatagcggttgtcctttaaccattgtatgttatcattcgtgtccagccatgcggcatccgtatcagtgaagatattattcagcgagttatcggatatcttggcgatccataccttatttgtattctgcgggcggtttagttgctgtatgaacaactcgtcgctttcggggatgaattccatacggggcaggtagttgttccggggatctccgggtatggcgatccaagtggtgttcccgccggtagaggaaacgtagcctacttttacggctgaattggtggttcctgccttggggtatgggaaatggattacctttgcgtagatggagtctacattattaataatgtcgaacactcccgttcctttcgtatcgctttgccaataggcgatatgctttccgtccgggctccagcggaaaccatcccggcaactgaactcctcctcatatacccaatcgaaagttccgttgacaatcgtatcgcttccgtcttttgttagctgcgtgattttcccggagtctatatcttctacatatatattattgttggaaacataggccacacgtgtgccatccggagagaatttagcgaacatcatggaggattccggcattccttttcccaattgacgtaaagcgccgtcctttaggtttaatacccaatagtcaccccgggtatcataacgccatacccgttgggtattgttataaatcaagactttctcattatccgcactccaagagatactacgtacgggaataggctttcctgtagatttgtctgtcaatagggatgaggggataatgacttcacgggagttatcttttgcttgataggcgacgatatccgtgcctccggtttgcttattattttccaagcggctataacgttcaccgtcttttagccaagtcatgcttccgacgccttttgtttgtatgacgttaccggcaacgatatcctcaagattcaacgctttttgtgccatgcttatacctcccgacagaaggctgatcgtggcgatcgctattaatttatttagtttcatgttgtattagttggttactactatatttatgcaaagaacggaaagttagttgatataacaaaatggatttgtatattcgcgcctcggaaatcaagaataatcataatttaattttatatagaaatcggaatgaaagcactttcaatgtatgtatggtcacttttagtgatcatgatgatgggatttacttcttgtggggatgatgatgagcttcaattctcggaagaacaattggcttatatcaacaaaaacaaggaatacatctgggaaaagaaaacagagaaagatgagaagggtgaattaagatataagcaagttgttctagggggtgataccgccttataccggatcattcggaaagaaaatgagtggacaacaacacccacgatgacttccgtggtctatttgctaggtctggaagggaagtttatagatggacaggtctttcaaaagaaactggatagatcaagtttttctatgaacggcattatcccgggcttaagcggtgtcttattgaatatccatctggatgagaccgtggaggcgattatcccggcttcgctaggttatggatatggagattatagcggtatccccggaggttctactttaatctttacttttaccttggataaggtcgaatgaatattatcagactaaaggcacatttggtttgatctgacttttatctttataagatttggcacggttacttaattccgccaacgggttaatagtataagtaggtgtggtgtaattgctttattttgaatatgtatacgatttgttcgtaaatattcgatagtttcgttgcttatctccttttttctttttaatttggcggattataaacataatcttgatattatgaagactgccattgttcctttcttgttgcttctgaatgttcttgtcgctgtaaatgcacagactaaggattctgttatcttggtgaaagatagtattacggtaaaattgccggatgtctacgttacttccgagcgtcctttggttacggttacggacgatgccttatctttcgacgtgcctaacttgatcatggccaaaccggtgaatactgcatttgatattttaggagagattcccggattggtgaaagaaggggacaacgttagtatcatcggcgtccctactacgaacattattattaacggacgtagaagctcaatgtcattgtcccagattgtagagcttctgaaatctacctcggccagcaaagtaaagagtatagagcttttgtatagctctcctccaaaatatggcgtaaaaggaggtagtataaatatcattatggagaagaaagtgaatgaggatttaagtgccgatatctctttgaccggaaagcaagctttctacttctcgccaaccggattagtgaatttatcctactccaaaaagaaatatagtctggatctatcttattccgctaattataaccattcccgttcaaccgaggatatgaacgcctatcctatcgtgaaggatcgtccttatgagatcctgcaagaaaatacggcggtaggtcgttctatgaaccatacgattggggcgagtgccaattggtttatggataaggggcgtgaggtggatatttcttattatgccaagataacggattctaattccaaacgatattcgaacactctatttgtgggtattgagaatgcggaaagtaataataagttatcgggcccgaagaatcttcaaaatgtacgattgaattatgcacattccaagaacttgagcgcaggggtggattatacctattataaggatcgcagggatcaatatatgatctcggattatcccgatacgaaacaagaggtggaggctacctcccggcaaaatatccatttggcgaatgtattcgtcaactacgaacgggtatttggaaaaggatggaaaattaacgcgggcacgaatgtgcagttatcctttacggataatagctcctttacctaccaagataaacaggaggatctgtcagctacgtttgcccaaaaagaaaaagagtatacggcgggattgtatgccggtttctctaagcgttttggcaagaaactggtgttgagcgcttctctttcggcggagtataataaggcggtgattgattcggcgggccggaagtggaccttatggtctggggtaaatctctatccacaattgaacttgagttatacgatcgatccatcgaatatgcttcaagtcaatttttccagcgataagaagtatccggcgtattgggccatgagctcgaatgtttcttatttgaatgtgtatagtcaggtacggggaaatccttatttggaaccggaacgtatttatatggctagggctaattatatcttgaaaaagaaatatgtttttggactatttgccaatcatcatgtgaattatattcgccaattgtattatcaagatacgaaagcgttgagagcctattaccaatcggttaatttcgataagcataatactttcggggcgatggcggttatcccgtttcggatcggtggggtggttagctcacggttcgtggcatcgggcttcttaattcaagatgagggagtgtttatcgatatttcgtttgatcggaaaaagttattcgggcagttgatgttgttcaatacgtttactttatcaaagaagaagaacttatcgctggaagtgaatgctcgctatagtgcgccttcgatacaaggtatctatgatgtggatggtatttataatgtatcggcagggcttgtctggaacccgataccgaaaaaattaagcgtaatgctacgaggtgaggacttattaaagggcttacgtgcgaaaacgcatattgattatcccagccagaagagtgatatgacgatctattcggatactcgttctgtatcgctcaccttaaagtatacattgggcaagatgaaccggaagaataagaaagagatcgattcttcacggtttggtcaataaagttcttatggaatccattcgataacgcctgtgactggatgttgttttttccagtcctctaattccgcatacgtacgcacgccgtcttgaatgactgcttggtaatattccacgcccatgattttcgctgtatccggtgtctcatatttcagttttaagatggcctgccgggtctcgtcagtcagtacggcggttatacgttcggccattttctcgaaataaccgtcataacgggaaccttttacgatatggatcatatcaatttgccagagttcgttatccgggtcttggaaccatgcgtgccactctacgcattgttcttccgtatcgagcgaatttccgtattcgatccgtttaatgagcgggttctccgctagtcgggccatcgctaggaagctgtcggatatacggaaaggagaagtgtaaatatgaaagtcgatatccttatgtttcatgagtagtcccatattcaaggagcctactaggtttatttccgccccgacggatttccatatatttataatgtcggtttgccggatcacttcccaagctctatcttggtttcttttcgctaattctaatagatgtttcatgatttaaataatttgaggtgtgaagttaagacacgaagcgggataaggaaatagctatttatagctaggttggttttaatatatcatacgggtacactatttccggttgtagggacggggcacgccccgtccctataagttggacaatatatatttatcttttgaataaccggaataactcaccgatccataaaaccagagaggaagatccgataatgatcgcccaatcttccaagggcaaaggtattacgctgaacatctcgcctccaaaagtgacgattaagtattgaccaatcaaaatcagtaaagcgaccagcaagaagcttttactatcctttaaattggcaaaagcggaacgtccttccataaatgcctttgcgttaaacatattccagaactgtagcatcacgaagaagctgaagaaccacgataaatcgtgcggcgttaaaccgtcttgcgcatggaaatagaacaacaagcccatcaagattacgacaaaagcgaatccgacgccgaaaatattataggccatcgggcgggtgataatgaaatctccatccttaccgctccggcgaggtttatctttcatcactcgctcattcggtgggagagaggccaacgccccggcagcgaatgtatccatgatcaagtttacccataacatctgcgtgatagtcaaaggagattccgtacctaataaagaacccaatagcacgatcaaacaagcggctacattgatggtcaattggaataacaagaatttctggatattccggtacaaggaacgtccccacatcaccgcacgggtaatgctactgaacgagttgtcgataatcgtaatgtcgctggcttccttggcaactgaagtaccgtcacccatggagaggcctacttgtgccgctttcaaggcgggggcatcgtttgtcccgtcgccggtaaccgctaccacggcgcctttctgctgtaataattgtaccaaacgctgtttgtccgtaggacgggcacggcacatgatcttcaagtctaagacacgatccaaggcctcttggtcgctaagcgcctcgaatgcgggacccgtgataatgttccggtcggtatcattcgctttccacgtaccgatctgtcgtccgatttctttagccgtacccggtgtatctccggtgacgatcttcacgtcgatacctgcgtccaagcaactttgaacagcggggggcacatccgcacgtaccggatcggagatagcgacgatacctaggtacgttaaatccgtatcatgtaaacgaccctcaacgaagaaggtctcatccattccatcctcaattatctggtaagcgaagccaagcgtacgcatcgcttggttctggtaatccaataattgtttttcgatgccggctttacattccgccaccggtttgtaagttccgtctatcgccacccggttactgttggccagtacgatttcgggagcacctttcacgtaaagtaccttcttgccgagtaacggtgattgtacgattgtagccatatatttccgttccgtagagaaggtcaattgatctaggatcgtagcgttctctcttaattccagataattttggtgttgtccgttcaaccagagtaaaagggcggcctccgtcgggtttccaagggtttttaccttttcttccgagaaatcgaggaatgccgtggagttcgtggagataccttctttgatcaggttacttaactcatcctccccaagcttttggtctttcaggttgtagaaattcgtttggtagacttgcatttggttctgcgtcaacgttccggtcttgtccgtacaaattacggtagtcgctcccatggtctcacaggcgtgcattttgcggacaagattattcgtcttcaacatacggttcatgctgagggccaaacttaacgtgacactcatcggtaatccttccggaacggataccacgatcaacgtaaccgctaccataaagtagttgaggatatgggcgatgatgtccatcgccggcatcccggggaaactatccgataaaaggaattttacggtcaaggcgatgaacgtcaccccggcgatcgtatatccggctttactgatcacgctagccaagcctttcaactgtatttgtaaaggagtctctacatcgctctcgatttgcgagccttcgtagaccttaccgtatccggtagcgtcacccaccttttctacttgcattacgccatgtccgtccacgaccgtcgttcctcgcatgactacattggacggataagtcgcttccgtatcgaaatccgcctcgtttgtagtcttgctgataatcggttcaccggttagtgtggattcgttgatctgtagggagatggcttcaagcaaatgtccatctgcgggaatttcctcacctgtctccaaaacaacgatatcgcctacgacgacctcttttttcggtatttggcagatattcccgtcacggattaccttcactaaaatatcatcattgactgtattcaagatatcgaatgccttgttcgctttcacctcgaagaaaaagcccacgcaactggcaagcatgattgcgaagaaaatgccgatcggctccaagaaggccgtaaaacctttcgcctcaggtccccagcaatgtacgccagcgattatcatggacaagagccatgccactaataatatacgaataataggatcttcgaatttctccaagaattggctccataacgaagctttcttgggcggggtaagtacattctcgccgtgaaggcgcctgctctcttctacttcttgtttggttaatcctcggtactgatgttttttctccataaatttattaatctgattaagaaaataggatagcaaattacgtaaagttatacgacatatacaagggtttaacctttttgcatatatttgtgttgtataacaaattaatttttaattaaaagatgaagaaagtactattcatgttattggttatgttcgctttgagcgcctgccaatcaaaggattcatatgtgaaggagtttagtgattttgtagataaggtggaaatggaggccgctgattataccgataaggactggaagaaggcggatctgaaattctcggatctatccacggatctttacgccaagttcgaggaagagttaaacgctgatgagaaagcggagatcattaaattgcaagcgacatacgctggattgaaaatgaaagcgggcgtgaaagacgctgccaaaaaagtggataagttcttggatggtttgaaggaaggaacaaaataacctctaatacgaaaataagatgaacagaaattgggtgtattcgctatttgctttatggatcgtctgttcgttcgcctgtacgcagcctaaacctgtggcgaatgtggatgttcaaaaagagaatttcgtattctctataaaagggacagatacattgtccttggacaagtatgagttgccttctatatcgcccgcctcaaaaaagcctgtgatgatttttgcttttggcggtgggtttaaagggggagataaggcggataaaggatatattccctatttcgagttcctcgcccgaaacggatttgtggtcgtttctacggattatcgtaccaccttgaagaatctggatccttctaaagtctcttctccgatggactttatcgcagccttgcagcatgcgatcgatacggcggtagaggatttttatgatgctaccggtttcgtgattaaccaaagctcggattggaacatcgatgtggagcagatcgtagcgagcggttcaagtgccggggcgattacggtattgcaggcagagtatgatttatgtaacggacatgagttggcgaaaaggctaccgacaggtttcaactatgccggtgtgatctcatatgccggtgcggtctctggtgtgcttcctccacattgggaaaagatgccttgtccgattatgctattccatggcgatgcggataaaaccgttccttttgaacaagccgctatggagaacctcggcggtttatggggatcatccgctgtagcgaaaagtctggaaaatcttcaagcttcctattatttttataaggtagagaatgcggggcatgagatctctgggcttcctatgtcccggaaccaatacgatatcatgagcttcttgagccgtcaagtcttaggcgatgagaatttagcgatcacgacagacgaacgtgttcccggtgatacgatcgtacggaaagattttaccgtacaggattatatcttggataatttgcgttaatataataatgaaatataaacagccttaatttgacctttttagattaaactattcacccgaaggattgtctttactatatagagtgattaatagtgtgtttagtttattaaggttatgagattaacaaggttagttggatttttagggattgtccttttttgtgcagggcaatccctttttgctcaaagtaagcaagagcggaaggagcaaaaagagaaagtagtgagggagatcgtggatagcggttgtattaagatcgatgtggatcgtgccgtaccgatggccgggagatccgtcaatcttacttccccctactcattggaaatacatggtgactcgatcctgtcttatcttccttactttggacgtgcttactctgctccttatggtggtggagagggcttgacgtttaaagaagtggcgacagagaaggagcaaacctctgaaaagaaaggtagttccgaaatcaagttccgtgtaaagaccaaagaggatgtatacatgtttcgggtggaagtctatccgaatggctcggtgacaatcaatgtgacacccgtgaataaacaggctattaccttttatggtgatgtcgccttagacttgaaatagtcgtccttgccgtgtatctctttcctcgatccgcttatttaccttagcggtaaattcgaaattctttaaaccccaatccggtgcgatcagtagctctttgggggattgtgatacgaacctctctactacgatagaggggttcagtcgttcaatgaagtcaatcactaattcgatatattcatcagccgtatataaatggaaatcagaaggatcttccttgaactctttcgccatgcgggtattcttgattagctgcaattggtgcagtttaagtgtcgtgatcgggaggcgtgataagacatccgcatggtgtaatatttcatccctactttctcccggtagtccgagtatcaggtgtgccccggtgtaaataccttttgccgccgtacgacggatagcggattccgattcttcatgggtatgccctctgtttatgcggactaaggtcttatcaagcgtactttccaatccatattcaatcatgacgaattttcgctgggaaagctccgcaaaataatccaataaaccttccggcatacagtccggacgagtgccgacaatcaatccttccactccaggataggcaagcgcttcctcatatttgcgaataagagagtctaatcggtcgtatgtatttgtgtaggcttggaagtaggccagataccgcatatccggatatttgcgggaaaaaaaacgtacgccttcctctaattgctcggtaacgcttttctccgtatgacagtattctggactgaatgtttggttattacaataggtgcaaccgccccatcctttagacccgtctcggttcgggcaggtgaagcctgcgtttatggaaatcttctgaaccttgaatttgaatagatcccgtagaaaatccccaaattcataatatcgtttagtttttttcataagacaaagatacgatttctcgcaatttgaatcacttttttatgctaacttcgcgtttcaatctgaaataaagagtataaatgaaacgattaggttttagtttattgctttcgttggccgtattcggaagtgtggccgcacaaaccggaagcaagcatgttgacttaaaagaaataaccgatgggaaatttcgtcaagtgacggctatcggagagatgcgatccttgccggatggagaacactacacagccatgaacgccgataagagtatgatcattaaatattcctatcgtacgggaaatcctgtggatacattgtttaatgcccgtaaagctcgtgaatgtacctttacggattttgatggatatacaatcagcagtaccgggcatcatatcttggtttggagggatacggagtctatttatcgtcgctctactaaggcggtggtttatgattatgacgtgcgtcgtaattatgtgaagcctatttccgatgccaagggtaagcaaatgatcccgactttctcgccggatggtcgtatgtgcgcttatgtacgggataataatatttggatacgtaagtttgatttcgacacggaggtacaagtcaccaaggacggtgagttgaataagatattgaatggcatcacggattgggtgtatgaggaagaatttgcggtgacaaatctaatggcgtggtctcccgatagcgagtatctggcctttgtccgttttgacgagtccgaggtgcccgaatattctatgcagatgtatggtgagggactttatccggggtattacgaatataaatatccgaaggccgggcagaagaattcaaaggtttccgtacattcttatagcgtagtcaccaaagacacgaaggagatgaaggtcccggtagaaggcgacttctatattccccgcattactttcacgcagaatccggatcagttggctatcatgacattgaaccgccagcagaatgtattcaatatgtattatgcaaatccgaagagcggtgtgttccgtttgatcttgcgtgaggaaaataaatgctacgtggattctgattggttgacttccatccagttcttgaacaatgggtttacctatgtgagtgaacaagatggctattctcatatttatttgtattccccgacaggtgttatgcaacgtcaggtaactcaagggaactgggatgtcacgaagttcttgggcgtggatgagaatacgaagactttctattacgagtctgccgaagaaagcccgatccgccgttctatctataagatcgacgctaaaggcgtgaagacaaaactctctacggaagagggtatgaataaggcggtctttagtgacaatttcgcttatttcgtgaatacctattccaatgcgaataccccggcgaagattacggtgaatgagacgaagaccaaaaaggaactacgtgttctgcaagataacgccgcgttgaagagtaagctgaaggaatatgtttttgctaagaaggaatttatgaaggtacatacggcttcggattatgagttcaacgcttggatcgtaaaacccgctgattttgacccgtcgaagaaatatccggtgatgatgacgcaatatagtggtcctaactcccagcaagtattggatcaatacggtttcgattgggagcaatatctggcctcaaatggtattatcgtggtatgtgtggatggtcgtggaaccggtgcccgtggtgaggcattccgtaaatgtacttatttgagaatgggcgagctggaatccagagaccaagtggaggctgcgcaagcgttaggcaagttaccttatatcgataaggatcgtatcgcgatctggggttggagtttcggaggttataacacgttgatggccttgagtaccggaaacggaacgtttaaggtgggtatcgccgtggctcctccgacggactggaaatattatgactccgtttatacggagcgtttcatgcgtaccccgcaagagaatttcgagggctatgcggctacctctccgttacgccgggtgaaagacttgcaaggcaagttattgctggttcatggaaccgccgatgataatgttcattttatgcaaacaatggaatatgccgaggctttggttcaagcgggtaagcagttcgatatgcatgtttataaagatcggaatcatagcatatacggtggtaatacccgttaccatttgtatacgaagatggctaattatttattcaataatttgtaagacatggcgcagcatttaagaaagccggattggttgaagatccggcttggcggaaatgagcaattcacgaagacaaaaagtattgttgaatctcattgccttcacacaatatgcacaagtggtaaatgcccgaatatgggtgaatgttggagccggggaacagctacattcatgatcggtggtgagatctgtactcgctcttgtcgtttttgtaatacgctaacgggtaaacctcttccgttggacccgaaagagcctgcgaatgtagcggagagcatccgtttaatgaatctcaagcatgcggtgatcacgtccgttgatcgtgatgacttaccagacttaggcgcttctcattgggtaaatacgatccgtacgatcaaagaggtgaatcctcaaacgaccgtggaagtcttaatcccggattttcaaggacgattggatctggttgatcaggtcgtggatgcggcgcctgagattatctcccataatatggagactgtacgccgtatcagtccgcaagtgcgtagcgccgctaagtatgacgtgagcttatccgttttgcgacgaatcgctgagcggggtgtggtagccaagactggtatcatggtcggactgggtgagaccgaggatgaggtgcttgaattaatggatgatgttttgctggcgggtgtttctgttttaacaatcgggcagtatttacagccttctcgcaagaatattcccgtctctgaatatgtgactcctgaatgttttgaatattatagacagcaagccgttggcaaaagttttaagaaagtagagagcgctccgctggtacgctcgtcgtaccatgcggaaaagcatatatgattcatgaacttttgacaatctttgttgttattaatataaaagtggactaaagggggggaaggaatgaacagagtaaagaaaggtctagataatcaggcgataggtttattgccattgttgttattcatgtttttggataactatttttcttatttattatcttttataattggggttactttctgttttgtttgtatttttttgtttcaggtgttgagcaaggataaggtataccaatttatgcttctaccatcggcgggcacattggtcttatattccgtatttctttgtctcaagcttgaaccagtgttgtttatatactctcctcttatcacggaagtattactggtcgtggcgttagcgatcgtggggttcacgaggagaacggtcatacaacgtatacgcgattcgaaacgtccctcttttaaacgtactttgcttcgtactaccttgaacgaattttatttcctcgctcagttggtacagaacctgtacacgttgcatcttttcatcatcttgttatatagtatcttgccggaaacgatgcagaatatgcgtaccgaacgtttcttataccgggagttgggattggtaatcggtgttttggtcattgtttatgagcaaatacgtttgtccttgatgcaaggtagcttgaaaaaggaaatgtggcttcccgtattgaatgacaatgggaaggtgatcggttgtatcgcacgttcggtcagccgctctttaccgaagaaatactatcatccgatcgtgcgtatcgcagttgtttataatggtatgttatatctggtgagacgaagtaaggatgagtttgtctctccggatacgatggattatccgttccataattacgtgctcttccgacatagtatagatagcacggtcaaagagactctcggaagtttggcgcaagataaatcaattgctccacgcttcctgatccgttatacatttgagaacgagaaggtgaaacatttggtatctctctatgttatttgtttacgtacggaagagcaattaaatcaatgtaagcgccgtagcggaaagctttggacagcgaaacaaatcgaggagaacttgagctccggggtgtttagcgaatattttgagaaagagttcgcttatttgcaaaatacgattctttttgccgagagtttctgttgcggtaactaatcatcttataatgcccgattccctagctctattacttccaaatctttgatatcctttcccgcaataacgaaacgtaataaggtacgtacttgatgaaagccactttttccagccgctcccggattcatatgcagacacttcaagcttcgatcgaatactactttcaggatatgcgaatgtccggaaatgaatagatttggccgtgtatcgtataattctttgcggatctcgggattgtagcggcccggataacctccgatatgagtcatcataacgttcacgtcttctaccttgaaatgagctactttaggatattgcaggcgaatggcttgtccgtctatatttccgtatacggccctgaaaggtttcaatgcctcgaatttcgcggccaaaagatcggagcctatatcgcccgcatgccagatttcatcgcaatctttaaaatattcggcgtacttatcatcccagtacgcatgggtgtctgaaagcaatccaactttaatcataacaatttcttttattgctcgaaagtatctatatttacacgcctaagataagaatattatggagaattcatatcaatattttaaacgggacttaagctggttgtcgtttaactaccgtgtcttgctggaagcggaagatgatacgctgcctatttatgagcgtattaagttcctttctatctattcctcgaatctggaagaattttatgagatccgggttgcggaacaccggggggtaatcatgaaaaagaattattcggaggagagcgcagctgaggcggaagagaccttggcggctatcacccgggaggttaaccgccagcaacgggactattaccgtattttctcggagaagatattgccggaattgaatcgccagaatgtttacttataccagaatgagaagccggaacctttccatgaagagtttgtccataatttctttaatgaggaggttttcccattcctgtcgccggtcatgattcaagccggtgatatacgtacgtttatccgggatcgtcggctttactttgtgatccgtatgattaagcggagcaagcggatgaatgagccgggcttcgtacccgagtatcattatgcgttgatgaagattccttatgcgaaagttccccgttttatagagttgcctcagcatgacgggaaatattatatcatgtttatcgacgacattatccgtgcgaatttacagaatgtttttcccggttatattattgatggctgttacagcatcaagatttcccgggatgcggatatttatttggatgatgagagccgggcgaatatcgtggagaatatccgtaagaaggtaaagaaacgcaagatcggagccttgagccgttttatgtatgatcaagcgatgccggatgattttctggcttttgtttgcgatgcctttggtattacgtcggaggacttggtgttaggtggacgatataataatttgcaggacttgatgaaattgccgaatccggcgggaaagcatttagagcagcagccaccggtgcctatgcgtgtgcctttccttgatgagatggggtcggtattcaaggccgtgaagaagcgggatatcttattgcatttcccttatgagtcgtttgattatttgatccgctttttgatggaggcggcctttgatccgaaggtggatgagatcaagattacccagtatcgagtggcagagaattcggccgtgattaatacgctggtcagcgctgcccagaatggtaagaaagtgacggtattcgtggaattgaaagcccgtttcgacgaggagaataatatgagtacggcagagcgtatggagcaggccggtattcgtatcatttatagtattccgggcttgaaagtacatgcgaaggttgcggtcattcttcggaaggatacgtccgagggacttaaacggcgtgatttcgcctatttgagtactggtaatttcaatgagaagacggccaagatctattcggatatggcgttattgacttcgaatacggagattattacggatatcaataaagtattcgctgttttggaagggcgtatgaaagaacctactttccgccatttgttggtggcccgtttcaatatggtctcggaattgactggtaggattcggcgggagatcgagcatgtgcgggaaggccgaaaaggacggatcatattaaagatgaacggactgcatgaccaacatatgatcgaggaactctatcatgcgagtgaggcgggggtagagatcgatctgattgttcgggggatttgttgcctggtaccgaaccaaccttatagcgctaacatccgggttactcgtatcgtggatatgtttttggagcattcacgggtttggtattttctgaatgatggtcaggaggatcttttccttacctcggctgattggatgcgtcggaatttgaaccgacggatcgagacggctttcccgatccttgatccggatctgaagagggaaataatcgatatcttgaatatccagctaagtgacaacgtgaaagcttgttatttggatggcgagttacgtaataattttaagtgtgatgataatccggtaaaagtgcgttcgcaattggctatctatgattatttgagaaataaatccatacggtaaccgggatgggggagttttggggatttgttgattggggggctggttgcttagccttgatcgtggcggtggtatttagctttttgttgggagtacgtacgggacgtatccgggagagaaatgaatctgtccgttctcgcattcggcagaataaagcgaatatgtatcgctataaacaacaattagcctcctatcaagagcaagtcgtacgcttggagcgggaacgggattctctggtcatccgctcggaggcttatgaccggatcgagacggagctgacggcctatcgccagaagatggagcagttggagagagagatccttgttctttccggcgataataacttattggacaatgctaccggaaaagtagatgtggatgtacctaagcttttatgtgcccttaaagatgatcctctccatgtgaatccaagtaaagaggaatgggctgagattattggtatgaccgatcttctgtttaataacttcttaaccgatctgagaaataaatacagtattacccgccatgagcaggaaatatgttgcttgatcaaatggaatttctcccgaaaggagcaactagccgtgtttaataatactccggatgcgttaaccaaatcgaaaggccgtttaaaaaaacgtttaggcttggatgaaaagacggatttggatgcctatgtccgtttattataaagcttaaagttattttgtttgtcgtgattgtccggcaatattatccgtttatctcccattgcgtggtttatatgtgtgattattagttgtttgatgttcgcttgttttgtccggtaccatttctttcctctttacgatccttcctgtacttttgcggtgtgtgatttaatttttaagaacgaataatcaggaatactatgagaacacaaattgtactactatggatcagccttagcctaatggtggggctttccgcttgtgattggacttcgtcctctccggtggcctcgctacggcgggctaccggatggcctttcgaggtggtggttgtaatggatcgagacgcatggaatggtgaggtgggggagttgctgcaagaacaattgcgagcgccgatacctgctttgcctcaagcggaagcatctatgcgtgtcacctattcggagccatcgggcttttccggtttattacgatacgtacgaaatatcttgatcgtatccgtagatcctaatcggtatacgaaagctggaacaagagagagtcccgatgaatgggccagcggtcagaatgttgtgactctgtatgctccgactaccgctgctttaaccgagttccttttattaaatgaaggacggttggtcaaccatttcaatcgagtggaaagggaacgttggatagttggactttctaagagccatagcagttggatcaatgagaagttgaagtcccgtttcggtgtctcgctgttcgtgccggaagatatgtcggcctataaggaagagaccgatttcttttggggctcgaataacgcaaatcggggacggactgatatcttggtatatagttttccctatacggctcaagaggcatttaccgaagattatctggtcgctatgcgtgattctgtagtgaggcggaacgtaccgggctctttcccgaattcttatatgaagactgagaggcgcttcgagctttcttacgagccgatcacctaccgtggcgaataccgcggcgtattgcgtggtctttggcgtatggaaggagataagatgggcggcccgtttgtcagccatgccctgctcgacaagaaaaaagggcgggttattgtagcggaaagctttgtctatgccccggaatcaaaaaaggcgaacttgatccgccggatggaggccgccttgtttacgttgcgattcgtggattaggattgattctctcacgtatataggcgtaacctcatgcgtatatacgcatcggcctacacgtacgtaagtgtggtcttatacgtatatacgtgtggctttatgcctatatagtggtcttatcgtcctaaaaatagtttgatttcctccggaatatatcccgtccgtatacgccactcttgcggatacaggttattggctcggttgccaaggttctttacaaaacctagcggaagtccttggtagcgtaccaacacatatcccttatctgtaccggagggtaagacgagcgcctctttctttaagaatttaatagcgtcttcccattccagttccacggatggaaatgcgttgggggttaaggcagtacttaaagccagctcttgagatgggataaagtctttccctttcgcttctcctaggcaaataccggcggaaagtacccgtaaaggcttggcattgatgagtgaaaatagatccgaatgggctttgggatacgctcgaaggaaactgtcgttccattcgagagaaaatgaagtttcatccgaaaggaactgacgggcctcctgtgggatggacggagcggcttttcctcgctcttttttccctttggacttgacacgaatctcctcaatctcgccttccgctttccggagggcggcgaggaaaaagccttcgccccgtgtcttatgcgggaagaagcggtaaaccggatgttcaaaccggagggcgccggtgatctgccattcctcttgggtagggataggcaatgcctcggctcccagctcctctattatataatgtatgttctcctcatcctcttccgtattataggtacatgtactgtagatcaagatacctccgggtttcaaggcgttccagatatcatggatgatgcgccgcccacgggaggcgcaaagccgtacgttatctacgctccattcgcctgtgctatccgtatctttccggaacatgccttcaccggaacaaggtacgtcggtgacgatcacatcgaacagatgaggcaatgcctcgccgatctcctccgggtcattattgataacgatcgtgtccgggcggccccatttagcgatattctcggccaatacataactccggctgcggatcacctcgttactgactaacagactacctttcggcaataagctcgccagatgcgtggacttgccacccggggcagcgcataaatccaagcaacgtaccggctctttcacatatgccttgatcgcttgttccagaaacatggaagacgcttcctgcacgtaataggcccccgcatggaatagaggatcgaaggtgaaagacaaccgttccggcaaataaaaaccgctctcgcaccaagcgaccggagcacctgctttgggagcgggagtccctttggagtggttgatacggatacttacgggaacatcagcacttaacgctgcctctaaacgatcgaactcctcgccaagtaaagcccgtgtacgggtaataaaatcaataggaagtgccatgattattctgttagtttgcggcaaaaatactacttttgcggaaaacaaacagtatgcaagcatctcttttccttataccagttaccttgggcgatacggaacatcgccgtgttttaccagaatataaccgtgacgtgatcttatccatccggcattttatcgtggaaaacgtgcgtacggcacgccgtttcttaaaaaaggtggagccggggatcgtgatcgatgacttgacattttatgagctgaataaacatacctcaccggaacaagtagctggttatctagctcctttggcgaaaggcgagagcgtaggcgtgatctcggaggcgggttgtccggcgatcgctgatccgggtgctgacgtagtggccattgcccaacggaaggattatccggtggtaccgttggtagggccttcgtctatcttgatgtcggtgatgggatcgggctttaacggacagagtttcgcttttcacggttatctgccgatcgatgcttccgaacgaacgaacacgatcaagaaattggagggaaggatctattccgagcatcagacgcaattgtttatcgagactccttaccggaataataaactggccgaggagttgatccgtacgtgccgtccgtctacgaaactgtgtatcgcctcgaatataacgtgtgaggatgagtatatccatactcgtccggtcaaggaatgggcggggaaagttcccgatctgagtaagaagcccactattttcttaatctacaaataagaggattgatatgagttatcaagcgcacgagacagcggtaatcgataccggttgtgagatcggggaaggaacccgtatctggcatttttcccatatcatgacgggatgcgtgattggccgggcgtgtaatatcggccagaatgtagtcgtatcgccgggcgtggtcttagggaataacgtgaaggtgcagaacaatgtgtctatttatacgggggtgatttgcgaggatgatgtgttcttggggcctagttgcgtgtttacaaatgtaaccaatccgcgcagcgctatctctaggaaagatcagtataaggagacggtgattggcaagggggcctcgatcggagctaacgctacgattatttgtggacatacgatcggtcaatatgccatgatcggtgccggggcggtggtaacgaaggatgttccggcttatgcgctggtcgtagggaatccatcccgccagatcggttgggtaagcgagtacggccatcgccttgtattcgactccgaaggattcgccacctgtccggaaagcggccaacgttacagcctacacaatcaccaagttgtagagacggggcgtgccccgtctctacaatacagacaatattaatattctatacaaacatgaaaacatcttttttcaagcaagggtttttagcgatagggatagcctgttgcatgcagctttccgccgtggagaatcctgtagactacgtgaatacgttagtcggtacccaatccaagtacgaattatctaccggaaatacctatccggccacggccatgccttggggtatgaacttctggactccccagaccggcgagatggggaatggctggacctatcgttacgatgcggataagatccggggattcaagcaaacccatcaaccgagcccgtggatgaacgattacgggcagttctccattatgcctactaccgaaggcttggtctttgacgaggagaaacgggctagctggttctctcacaaaggggaagtggctacaccttattactataaggtctatctagccgatcataacgtgactaccgagttggtcccgacggaacgtgcggctaagttccgctttacattcccggaaaccaagaaagcgtatatcgtgatcgacgctttcgataaaggctcttatgtaaaggtattgccagcggaacgtaagatcatcggttattccacgaagaacacgggcggtgttcctcgtaacttcaagaattatttcgtgatccagttcgataagccattcacgttctcctctacggtcaagaacggagcgatccagttggatgagtcggaggtgaagacaaaccatgccggcgctatcatcggttttgagacaaaggccggcgaggtggtgcatgccaacgtggcttcttctttcatcagcaccgagcaggccgagctaaacttgcgtgaggtgggagatactagtttcgatcagctagtgaccaaaggtaaggaaatctggaaccgggaattaggtaagatcgaggtagaggatacgaacatcgataacttgcgtacgttctattcttgcttgtatcgttccttgcttttccctcgtagcttctatgagatcgatgccaagggccaagtcgtgcattatagcccttataatggtgaggtcttgccgggctatatgtttaccgataccggtttctgggatacgttccgttgtcttttccccttcttgaacctgatgtatccggagatgaaccaaaagatgcaggaaggtttggtgaacgcttataaagagagcggcttcttgccggaatgggcaagcccgggccatcgggattgcatggtcggcaataactccgcttccgtggtagctgacgcttatatcaaaggcttgagaggatacgatatcgagacgctttgggaagccttgaagcatgacgcgaatagccaactgccgagaacggcttccggtcgtgtcgcttacgaggagtataataaactgggttatgtaccgaataatatcggtatcggacaaaacgtggctcgtaccttggaatatgcttataatgactggacaatttatgcgttaggaaagaaactaggcaagccggcaagcgagatcgatatcttcaagcaacgggctaacaactataagaatgtgtacgacccaaaatataagttgatggtcggacgctctgataagggcgagttcaacccttcttttaaaggtacggactggagccgtgatttctgcgagggtaatagctggcattggagtttctgtgttttccacgacccgcaaggtcttatcgacttaatgggaggaaagaaggaattcaatcatatgatggattccgtcttcaagatgcctagtcgtttgggcatggatagccgcggtatgatccatgagatgcgtgagatgcaagtaatgaatatgggacaatacgcccacggaaaccaacccatccagcatatggtatatctatacaactattccggcgagccttggaaagcccaatactgggtgcgcgagatcatgcacaaactttataccgctgaggcggatggctattgcggcgatgaggataacgggcagacttccgcatggtatgtattctctgccttaggcttctataccgtatgtccgggcaccgaccaatatgtattaggtactcctctgttcaaatccgtaaaactccatctggataacggaaagcaggttttgatccaagcggacaaggctgatcgagagaaccgttacatcaagggtatgaaagtaaacggcaagacatacacccgcaatttcttgacacacgagcagttgctaggtggcgcgaaaattcaataccaaatgagcgatacccctaataaacagcgaggtacgcaggatagtgatcgcccctattcattctctttggaataagaaaaccttgatgcccattgtaagcatgttacaatgcctattctaaacaccttacgatgcccattgtaaagatcttacgatgggcatcgttgtttcttgtaaattaccgcttaaaataatagcggacgggaattgttttttattattgattgattacctttgtggtgacttatccgtctttcttaaatccttttatttattagatgtatggcaaactcaaaagagatgacggggggagctgtattccctcttctattcagtttcacgatgccattattgctcgggaacttacttcagcagacttattctttgattgatgccgctatcgtaggtaaatttcttggtatcaattcgctggctgccgtgggggccagtacctcggtgattttcttgattctgggattctgtaacggatgttgcgccggttttggcatcccggtagctcagaagttcggggcgagggattatgcgacgatgcgccgttacgtggcggtggggttgcaattggctacggtaatgtccgtggtgatcgccgctgtctccggtttctattgccgggatatcttgcgggggatgcagacacccgggaatatcttcgatggggcctatgattatttgtttgttacttttatcggtattccttgtacattcttctataatttgttggcaagtatcatgcgggctttgggagatagcaagactccgttctggttcttgctgttctctacggtcttgaatgttttcttggatttattctgcatcttggtactaggatggggcgtgatgggagcggctatcgctacggttttctcgcaagggctttccgccattttatgttatttatatatgcttcggaaatttccgatcttacgggctacttcttccgaggatcgaaggtttcatgccgggctggcccgtaccttattggcgatgggggttccgatgggattacaattttctattaccgctattggcagtatcatgttgcagagcgccaataacgccttgggcacggcctgtgtcgctgcctttacttccgccgcccgtatcaagatgttcttcatttgcgcttttgagagtttgggtatcgccatggctacgtattgtggacagaattatggggcgggaaagccggagcgtattttgcagggaattaaggtaagtgcgttgatgatgcttacgtatgccgctgctacatggatgatcttgatgctggggtctcgttggctggccttgttgtttgtggctccatctgaggtcgaaatactggactatacggagcagtttttgcatatttcttgctggttcttcccggctgtcgggctactgtgtatcttgcgttacgcgatacaaggggtaggttttagcaaccttgcgatgctctcgggtgtttcagagatgatcgcacgtatcttggtgagcttgtatgcggttcccgcttttgggttcttaggcgtttgtttcggtgatccgttggcttgggttgccgctgacttattcttgatacctgcgtttttgtatgtttataaaaagataaagaaaagattagatgatgagaaagtatcggtgtccgcagtgtgatatcccttctatgtatgtaaagaatgcggctggggaacgtcttttagtgtatgtttacgagaatggggaggtcgttcccaaagaccctgccgcggatctgtccggatttgacttgacagaggtattttgcctaggatgctcatggcatggagcacctaggaaatgccggtgatttttgtatctctatcctctcggaagtgataggatgcgtgaatgctagatattcagcgtgcagatagagccgttccgcctttcgtccgtaaagctcgtcgccaaggatggggcaatgaagacctaggggatgggcggcgtgtacccgtagctggtgggtacgtccggtttggggataaaaggcgataagggtttttccggaagtccgttccaatacccggtagcgtgtaaaggcaggtttcccgaattcttcgcttacgatttgccggggtctgtccaaaggatcgggacatagcggaagacggatctcaccctcatcttggggaacttcaccctctaataaggcgatataccttttctggatggttcggttcttgaattgggcttgcaggttctgatgcgcttctttggtcttggcggcgagtagcaagccggatgtcgccatatccaagcgatgtacgataattgggccggtggcatccggataaaggatacgcagcctgtgatagacggagtctgcgtctcccttgccggggacggagagcatacccgccggtttattgacgatcaacaaatagtcgtcctcataaaggatatccagcttcgtctcccggtgagagtccgccaataacggattctcatctacctgtaatccctgtagcatatggttgaggatcggctcgcattttcctttgcaagccggataataatatccatggtgccggatctccgtcttgggagaatcgccccaccagaactctgccatggcgatcggctccaactgatgctggtaggcgtattgcaagagtttaggggcggcgcactcacccgctccggcaggcggcgcaccttggtaggtaggggcgaacagttcgcataagtccttcacttcgctccgggcgttcaggattcggaattgttcgaacaacttgcgttgcaaggccgccgaccgtcgcttgcgttcttgcttcagttgctcgatctcctgctcaagccgatccaccttggcttgatcctcctccagtatagaccgcaatgatttcttggttagcttgtgagcggctttcatgtgttggctctctttaataagaagtgcggtctcttcttccgtgagagggaactgccgaagtcggtcgcgctcctctttcctctttttcatcaagtcttttgcggcctgtaatacgaaatcgcagtattcgatcgtgctttgtaacctcgaccgtgcgtcttcgagagctggagaggcttgcagggttcggatacgggcattgacctcattgatccgctcctcctcttgccggaagaaaccatccggttgtaataggtcatagatcggggggacgaagaatggatgtacattcttccctgctaggttaccggagaacgcggccagatagccggcctctccggcgggagtacgaaccaccaatacgccgaacatttttccggcttgtaactcttcccgccattcggttcgttctttcaggtatgcctgtgtttcctcagccgctattacgcatagaggatgcggtgtatagtgaaaaggatacgtgaatcgttccggtaaggggatcgattgtatcggttgggcaaacgtgtgaaacttagattccatcattcattttttaatagacaataagcgtaaacggccggtgccgtaggatctccctcttgatacaatcccggacgggagatacgatcccattggatcaacgaccgggtctctttcgcggagagagcttcgctgacgatctcgttccatgcttgtccgtccttactccagtagaacgtgctatgcgtaccgtcggtcactttcatccgtagatataaaggcgaggcgggaagaggaagatcggccaatggatgttctttcccctctaggatatatttcaatatcaaacggtctccagcgcatccgcaggtgattaggttatttgcgtctccgtacatcgtgattcctttccaactgtcattccggtttacgatcgctgtttccaacgtgtaatccggggaggttgggcgtaaacaaagtgccgctccggtctttacgccgggtttcggtgttccggatagagatagtttaccgttcttgatctcggtcttgacatccgtgtaaggatagttccaactccattcgggacgcaaggtagcaccggtgaaatcatccgagaaatcgaataccggcacttgtgcggactcggcaaatggcatgggttgcgtgcggctcgcgtattcctcggttacgaagtgaggccaatgatcctcacccattctcacctcttgcaggtaaggttggcgaccttggtagaagccgcttcccggctggtaagcgtggcataggtaatacatgcgtccgtccggtgtagtcgtaatcgttccgtgaccgatggagagaacctccttgcttccgtgcaagatcgggttcccttggtatttctcgtaaggaccttccagctttttcgagcgagccacggatacggcgtaatcgctctgcgggccgcaacagcctctcacggagtagatgatatagtaatatccgtctttcttgaaccaatgctgaccttccataccttgacgctcatcgtcacgcagcaggctgaaaggctttccgtctaggcgaagcccatcgtccgtcaacttacaggccaataactctatgggttggttatccaatccataagccttccaactgatgtaaagtttgcctttgtcctccaagataaatgcgtctatcgcttccttcccaaactctaccaccgggccgtaatccttgaacttgcccgtaggtgaatccgccacggcgacaccgatgcacgagatgttatccgattgcttccgggccgtataatagacatataccttccctttatgctgataccattccggagcccagaatgaggatttagtccattccggcttctcgtcgaatacatgtccggtttgctgccagttcaccaaatcggtagaggtgaaaaccggataataaggggcccattccgaggaggtgccagtgatatagtaagtctggtcgatccggataatggaaggatcggctacgtcaccgtggatcacgggattggtaaaataggattcttgttgcgctagtcctgtggccaaggaggcggcacagaagaatagtgtgaaaatctttctcatgttttatcgtattttttttaagatattcttacgtacggttcgcaaagagatttgtagtaaatcgggttccgccagatcaagtagtgtcttatactcctgtaatagctctggaatgggacggcataactcatatcccagtttcatgcaaagcgtttgcacaccgggtaattccttcgctgaaagcatccggtctaggcagaagttcaggaaatccacccgtgggggattcgcttgaggctgtcgtaaaagcaaattcaatagaagacgtcgtttaccgggatgcttgcagaccagaatctcgtttatcaattcatcttgtttatcgtatagccatttattcttatctgcggaaaaatggctacaggcccataacgcttgataaccgatggtctcgtccggatcgaagatcaaaccgtatagttccgatttccgtttctggcttccttgcacatatcgcaatatctcatggatatcctctatgtggatgcggtcagataatctctctcttaaatccatttacaatattgaatcttatatctttcgatcttttatgccgtaaagttatagtctttttagcaaactttctctaattctcttacttttgttcccattcgtttcatcggcgtatacttcatcccatgcgtcacttgttcctcacagacaggctcgaatccgagctttctgtagatggggattgcgtaagaagaggagttaaccgtcatttctgatacgggctgatttaagatcgcggtcttgaacaattgtttaccgattcctcttctatgataagacggtttgataaagaataaggagatatgttttccctcgttttttgtcgcgattacgccaattaaagactctccatcgaaggctccgtagaaggttaattcatttactagttgcttattataaatgaaattcttgaaagtttccagcccctcttcatcgaaatcctttcttccgcattcgatgaaaacgtccagagataagtctaatgccttatcgtattcatttgccggtaattgtcgaatttccatagatatgttattctttttgattctcttctagtttcttatctgctaccaattcaaaatgatgcgcatcaatgaattgtccgtttttgtaacaagcctttctgaaaatgccggtcttcctgaatccagctttttctaatactcgcatggaggccggattatattcgtagaccgtggcgaatatacgaataacctccgtatgcgcgaaataatactggatggcctcggttaacgcatccgaaacaattccttgattccagtatttctcactaatccaataacccacttccgcattgaaacgctctacgtccgtacctctcacaaaaccaatgttaccaatagcctcgccaccaaccgtaatacaaaaatccgatatatctgttttctcctgcgcttgtttgatgaagaagcgggcattcccttttgtataaggataaggtaatccatcccggcagttatcccagattttcttattgttcaaatggaaggctagggattcggtgtcttgatcttcccagctcttgagcgtatataaatcctttattactacaatcataagatgttgtttttacgggataaggacggattctcaagataatagcacaggtggtcatatatttgcccattatacattaactctgcttgatgaagccgtccttcgtatatgaatccattcttctctaatacacgttgtgagcgttgattgtgaggataacaattcgccgtgatcaaatgtaaattcatttgaatgaacccataattcaatacggattgcactgcttctgtcatgaagccttgtccccaacactcttcttttagccaataacccagcatgcgagcatgtgggttttctcttttggaatcaggaatgatgccaatggagccaatgacttgttttgtctcttttgatacgatagcccaaaccccttctttcccgataaaaatggcatttagaacatcgattgtctcctcgatcgtttcatgaggtttccatccggcgttattgcctaggtttggattcttacagctctcaaaaacatcaggagcatcgctttcgctgaaaggacggagcacaagacggttggtttctatgttcgatgtttgtgtcatatacggatgtttatttagtcgagatagatcattttcttggtcatcccaccgtcaatcgtaatattctcgccattaatgaaatcgttttcctcttgacagagaaataagcacatacgggcgatatcctccggctttcccacccttccggacggatgttgagcatgatcctccggacgaagctggtcgtaattgttattctgtatccaaccgggagcgatagagtttaccgtgatatgccattccgagagcgataaggccaacgcatgtgtcaaagaatagatacctcctttagaggcggcgtaaccctcgctaccgggttcactcatcaagtaacgggtagagcagatgttgataatcctgccgtatggattgggggtatcgagagattgccgatggagcgctaattggcgggaggtgataaacgccgggcgtaagtttatggatagtatcttgtcgaaatcctctacgcttgtttccgtgatgagagagaactgactgacacctgcgttgttgataatgatatcaatatctccccactcctcgatgatctttcgcaggcaatcttctagtgcggttttatcactaacgtccacgagatggaattgtgtcccggtttgtagggcagtctcttttcctaaggtctcgttcttgtcgcagaaggccacacgatgtccggctcctctgaaagcccttacaatcgctttcccgatcccctcggctccaccggtgatgaagactcttcttgttttatgaagtgtcttcgttgtatgccccgttctagtgccggaagtcttccgggcttggtattctgcgtacttattttccagataattgtctgccatgattcagtcactattaaatgaggacaaatatagttgttttctgtcgaaccgatttcttttagtcgatattctgtttgggatactaaaatagaaccggaaattgccatctaaattgcttgtggatttgttttaatagaaaagtattgattatgagaatagcgatcagcggggcaagcggatatatcggtcagcatctttcatcttttttggagggaaaaggatatgatgttatccctttagggcgggatttgtttaaggaagattgttttgatgaattatgccgatgcgtggaatcctgtgaagtcgtcattaatttggcgggcgcttccattaataaacgttggacggaggcttacaaacaagagttgtatgatagccgtatttgcgtgaccagacagttggtgcatgccataaacacgagaagcgtgaaacttgagttgtttatttcggcctccgccgtaggttattatccggctttcggggaatatgacgagtatcatgattgccggggaatggattttttggcccggttgtgtggggcgtgggaggaggaagcgtccgcatgctcatcggatgtgaggcttgtcattacccgttttggtgtcgtattgtctgaggatggaggggccttgaaagagatgcttcgtttgcaacgcttctcacgggtaagtgtcgtgatcggtaacgggcaacagcgttttccatggatcagcctgtttgatctatgccgctcttttgggtatatcatacggaataggcagatgaggggtgtggtaaatttggtttctccagaccttatcacccaaaagcagttggctcatacgttagcgagagcggataagatccgtaggatcatccctttgcctgagttcttttttcggctgaagtttggcgagggagcgtcgttcgtgacaaaagggcaaaccgtccatccctctaaattacaggaatctgggtttacatacatttatccaacaatagagaaacttatgaatataacagatcatcataccgtaccggaactggatgttaaacggtatatggggcgatggtatgaaatcgcccgttatgagaatcattttgagagaggcatgacggatgtgacggccacgtatacgttgcttccggacggaaagatccgtgtggagaacgaaggatataaaggcggcgttcacaagaaagccaccggtcgtgcgaaacaaccggaccctaaaaataatcccggaaaattgaaagtggctttcttcttatggttctatgcggattattatatcttagaacttgatgcggattatcaatatgcggtgataggaagcagcacggataaatacctctggatcttgagccgtgagaggaacttaccggaggcggttcgggaagatttactggggaagataacggaacgtgggtatgatatctctaaattgatttcatgagctgatgtataaaggggtaaagccgtagtgattacgcctttgccccttttattactcatattggaaaacaatcttaacagaggcgatctgagagagttccttttgctcacatgataggctttacgatttcaattttaaggccaagcgcatcaataatacggaaaaataaaccaactcccggttctatgattcctttttcaattcttgatatataggtcttattagttcctactttttcggccaactcggattgtgtcattttctcttgcttccgtgcgtcactaataatttgccccacacaataagagtatgcttctttgcgaaactcctctctttctggtgagccaaccttgccgtataatttatctaatacagcgtccatactcccgatcttaggatttgcttgcataatattcattttttttccatagtgcaaatataaattaagtttacatatataacaactttagatagacttttcttttatgttttcagttgcttcccatcggaaaaggcatttcctaccttttcgcccactctcaaatagtcgttgttgaatggatcaaagatgatgggagcggctttagctacattcaccttgccgttctcatcaagtacacgctcgtcaacactgacatttacgatctcgccacggagtatgcaagtatccggatcgtaatctttcaatttacattcgatagccacggccaattcgtcgatcaacggagcatctacgaagtccgattttgtagcgtgaaatcctgctttggcaaacttgtcggtaactttattgcccgacacgatacctacataatcacaagctacgacatgatcggcatctgccatgcttaccgtgaaagctctacgcttcaggatattcttaactgtcttgtgaccggcgctaagacacatgctgatctcattcatctcactgataccgccccaagcggcgttcatcgcatcgggagttccatcttctccatacgtggcgataataaatacgggttgcggatagctcaaaggcttcgctccaaaattctttctcataatcatttattttttagtccaattcttgatatcttcttctgtcactccgttcatcaacttccctttttgccagttcacatccggataggctttccgcaattcgctctctgcgttcgagatactgctgctgcctgatgtggcgaatgggataacggttttacccgagagattgtatttttccaaaaaggtgttgatgagtcttggggcttgattccaccagatgggaaatcctaggtaaacggtgtcatactccgctaggttcttcaaatcatcgataatggccggtcgtgatgtaggatcgtccatctctacgctgctgcgtgaggatttatcccgccagttcagatcggcggaggtatagcttttctcaggttggatcttgtgaagatcaccgctgacaatagatgcgacttgttgggccgctttttcagtatttcccgttgccgagaagtaagccactaaaacttttgtcccttcggcagccttttgcgcataagaggcgatacataccattgagaccatgaccatgaataatacgattcgtttcatacttcttgaatttttgttgtttttatattcattacgagaatgctatgtatttatggcgataaagataggagagaaaaatgaaacagtttgtacccaaattactgatatatctgatatttttggcgatacgatccttatctttgtaaggcgattaactaaaagaagaaaatatcatgcttgcgtacacttatattgaacaagggaaatttgaattgcgggagaaaccgataccggaaatacaggattcatgggacgctatcgtacgtgtgactttgggtagtatctgttctagcgatcttcatatcaaacacggtagcgtaccacgtgcggtacccggaataaccgttgggcatgagatggttggtgtggtggaaaaggtgggtgccgatgttactgcagtcaagccgggtgacagggtgaccgtgaatgtcgagaccttttgcggagagtgtttcttctgccggcgtggatatgtcaataattgtaccgatcccaatggcggttgggcgttgggctgtcgtatcgatgggggcaggcggagtatgtccgggttccttatgcggatcgaggcttgaatcgtatcccagatacggttagcgatgagcaggctttgctggtcggtgatgtgttagcgacaggtttttgggctgcccgcatctcggagatctcagaggaggatacggttttcattattggcgctggtcctacggggatctgtactttgttgtgcgtgttgttgaagaagccacgacgtattattgtttgcgagaagtctccggaaagggcccggttcgttcgccagcgttatccggaagtcttggtgacagatcccgaaaactgtaaggaatttgttcttcgtaacagcgatcatggcggtgcggatgtcgtattggaggtcgcggggagtgaggataccttccgcttggcatgggattgtgcccgtccgaacgccattgtcaccatcgtagccctctatgataaacctcagcttcttcctttgccagacatgtatggcaagaacttgactttcaagactggtggggtggatggctgcgattgcgccgagattcttaacctaatagaagaaggtaagatagacacgacgcctcttattacccataagtttccattgagcgagattgaggaggcttaccgtatcttcgaaaacaggttggatggggttataaaggtggcgattgaggggaatctcatcaaacctgtctttgttttgccgcatacaccttgattctctcctcgcaacattgtcgcgtgatatcccggagccgttctactttgggtataagcgcctcgatatcttctttagtgacgcggaagtgtaaattataacgagcttgaacgtatgcgtcctgcagcaagtcgaaaagtcgtttctcctcttccgtatcccggggaaaggcttcggatgactctagggaatgcgttttggctctgccggataacgttattaggctatgctctttgggactatacaatgtaaaagtcaagattatgctgttgtaataattctcacaagcttgatgaaggtggaacgatgctattttgtaatcctgatccttgtatgaatatcgggcactacgtaagaaactattcgcacgttcaaacctgtcgttgtaatactcctccgccaactcttttatttcgcgatagttcagtttacgacggcgggccagcttataacgaccgctgttgtaaagcatgataccctctcgcttgatatcagtatagaaatatcggtttttatcgatggctttattcagatcgtcgatgctctcgtctataaactgtacggtggtggatacgtatctgttcttccctttgtagtaattatcggtggccttactcaagatgtgattgataatatatctttggaaacgggtactggtaactaccaaaatatcataatcgctcataaaacaggtgcggataccgtattcgatgcgttggtcgtagtcaacgtatgtattccgggcataacttccgtagagaatgatcatctcacaatcgggaagtacttccagtacgcactctacaattcttctgaggtcatcccgtttctgttcgggaaggtaattgatggatgttttcattcttcgtttatctatgcaaattgtttgtaatcactttttactttcaatgaacattgttctgtcccgatagcctttacgatagctaaaagcggtgcgctgaactgttcggttagcttgttcggtacttgttcggtcgacttgttcggttggctgttgtggggtcatgattttctcccatcattaagtttctgaaaaatgcgatcaagaaactcatatccggttcaacgtcttttcgcacatttctataattcgtacgaaccagcgcattgcggaagtaccaagagttgtcggcaaacagatcattgttcacgtcaaaaccgatgctacgtaaatgctttatagcaaagaccgccgtagtacgagtgttatcctcactactacggatgtatgatgtgaaatctatgtccatatgtatccaatcatgattataaacaggcaataaagatataaaatatcctgctatgtgatagtgaaaagatgaagaagttgtattggctcggtcttttacgtattatgagtttcctgtaacattgaatttataaaaatatctacaatatctaccactctattatatactttttgtaaatgagagtattatctgttggttgtagatgtccaaacatctacaattattattcaatatctaccatttattattgatttttatacaattttcttttcgtgtgaaggaaaaaagtgttatatttaaagaatactgaaaatctaaaagatatgatagaaaaactcgattacgctatggtgccgacaggctttgtacattgttttaatgaaaattgtaagaacgccaaccgctgcttgcggcatcaaatcgtccgttttatccccgatacgctttgggcggtgagcatcgtgaatcccgcacgtaccagtcctaccggaaagtgtgcggctttcatggcggatactcccgtgcaatacgctgttggcatggatcacctattagaccagataccttatctggaggcgaaacgcatcaagcaacgtctgttgatgacatacggtaagaataagttttatcagtttaagcgcaaggaaagaaccttctcgcccgaagaccaacagtatatccgtcaggtctttcgggcgtacggagtagaggatgaaccagtctttgatgcttggcagagtggctaccgatggacgaagggataagagctgataagagtttcccttaggagaacaaagagtttctcttagggaaaacaaaagtttctcctagaggaaacaaaagtttctttaggaagaaacaaaagttttcccctaataaaactttagtttttctataggaaaaactgtaagcataagttattcaacttcttaaataatatattagacatgaaaataaccaagcaaacagcctatcgacataccgtcgcacaacgggcgatgcgtatggaggagatcgtggcatgggtaaaggatgagcggacgagggataagcttgcgctctttcgagagaaattaaggcgggcttatcccgacaaacggtatccgtttacccggaaattacctctgttgctctttgccggaacttttcgaaaaggcgagttgaaggagtataatggctggattttgctggagatcaatcgattgaagagcatagaagaggctttgtccttgaaacaaaaaatagtggaatatccgcagacactgttcgctatgatcggctctagcggacggagcgtgaagttcgtggtggcttatacctatcccgacgggtcgcttccccgttcgcgtacggatgccgaggtttttcatgcgcacgcttaccgacatgcgctcaagacgtatgagcctcgcctttcttatcccatcgagctgaaacgtccggtgctggagatgggctgccgcctcagttatgatgccgatgtgtattacaatccggacgccctttccattcatctggagcagcctgtggctatgcccgacgaaagcgcctaccaggaacggttcgaaaaacgggtaccggtactggtagagagtgccgggcagacgctttatgaccaataccgttacgttgccatccaatatgaattcgctttgcagcgggctttggaggaacatggaagtttgagcataaaggtggatttcaaacctttgttggtcactcttggaagactttgtttcgcggctggggtagaagaggaggattgtgtgaagtggacgatgctttatttggggaatctgatctcggaagtggagatccgggagaccttgaggcagtcgtatcggttagcctccgattcggactttggttgtacgtccctttacaagccggagcaactacagagcttgaaaatggaggagtttatgaaccgccgttacgatttccggtacaatctgatgtctggcggaccggaatatcgggagaaaaacaccttctgttttgactatcgccccgtgacggatcgtgtgctgaacagtatcgccttgaatgcccagaaagaaggattgcagctatgggacagggatgtacggcgttttgtcttttcagatcgcatcccggactatgcgcctatcgaggactatttgacccgcttgcccgtgtgggatggcaaggatcgcatccgtccgctggccgcacgcatcccttgcgacaacgtacggtgggaacagttgttttacacttggttcctgtcgatggtagcgcactggcaggggcgtgacaaacagcatggcaacagcctttccccgctcttggtgggcgggcagggatgcgggaagtccacgttctgcttcaacctgttgccaccggacttgaataagtattacacggacagcatcgatttcagcaagaagcgggatgccgagctgtatcttactcgtttcggattgattaatattgatgagttcgaccaagtgagcgcgaggcatcaaggcttcttgaagcatctgttgcagaagccggtcgtaaatgtgcgcaagcctcatgctacgcaggtggaatcggtgaaacgttacgcttcctttatcgctacgagcaaccatacggatttgctgggcgatccttccggcagccgccgtttcatttgtatcgaggtgaaagggatgatagacaatgcccagcctatcgattatctccagctctatgcgcaagcggttgccgccttgaataataacgagcgttattggctgacgcatgaggaagaggtctcgcagatgcaagcgaacgaggcgtttcaacaacgtcctttgttcgaggatctgttttttcaatattatcgtcccgcttcgcacaaggaggaaggtttgaagatctctgccggagagatctacctatcgctgcaaaaaaagagcggcgtaaaacttccgatgagcaatgtctccgtctttggtcgcttcttgaaaaagatagggctaatgacacagttggcgagtaggggacggttgtatttagtggttgaaaagtagtaaatggtggtagatgtaagttgttggtggtagatgttttattatctaccaccattagataagtgatttatcccacttctggatcttcccaaacacctgttttgttcattcgatagcttctctctatcttttgggaagagtctgcctccagcgcatagagtatttcacgacagaactccagagttgcaaatccgttggcggtaataatgtttccggctctgacagccggttcatccatataaagattttcacctgtataattaacccccgcaaattgtttgaggtaatccaatccgttgctggtatgatttacatggttcaagaaaccgtgtataccaagaaaaacggaggcgttacaaataccggccaccagcctcttcttctcgatggcctcttttaccagaggaacaatggcttcggcttccggggtgaaccagctcatgccacctattaatacgatccctgcataatcggccggaatgtcatggatctcatagtcgggcagcaccttgaaccctccgatcgatacaaccggctctttcctgatagatacggttttaactatatatttgctttcacttccgggctcaacacctaaattgaggttgggagcgatataagccccttcccaatcggcaaagtcttttaacaagacgaatagaatttcttttttcattatttattgtatttatcgaagttatacttctttctaatctcgttttgctcgtcaggcgaaagagatttgaaatatcctttccaacctgggcagaagtttatgtgccaacgccaaaagcgtcccattaatgactgaggacttttatcgtattttttccttagggggcagttgttgcagttacttttttgcatggatgttacagaatgcttgttgtttacaaaggtagtgcttttattggaattgctttatttcaatctttgtttattatgataatataccccatctgatataattgccaatatttatcgtaattttgtatccgaaatggtatacgaagtgcatctatcagccacggtcaaaatgttgctgttaagagaacggattggcaggttttcatcgaaataacaaatatagaatactgattatatattcgtgtaggtaaggaacccccttgcaggcttcgtgaagtgatgaatgtttggagctttgcttagaaaagttcgaaagaatacagcaactagacaggtcattcaaaaaagttagcgaatagttaattggttctcaataaaattcagtatttttgcactcacaattgaataaaagcaattagcaaattacaatgctgcagaatagagtgaacatattagtaaacacattatgtcgaagcacagtatgctttgagagtatgtcgtatgttcatactttaggcattgagtcattcggtaaattcaaaaacactttccagcgaacgttttatagacaggtaggagtacattaggtgcaggtattcctattaaaaagataaattgaagccgttgaaaagtccttactaaatttttcaacggctttgtttttgcccattggtgacgttcgcattatgcgctctactccgtcatttccgtccatgggcattgaaaacttcagttttattaaccagcgcagtgatgtgcataaaaaaagaagattatggattacaaattcaacggaagcggggtattctttacatctgatacccacttcaatcataccaatatcatcaggttctgtagcaggccattcaaggatgtagaacacatgaatgaaacacttattgccaactggaaccgtgtggtcggtccggataatatcgtatttcatcttggcgacttctgtcttggtggctctgctgaatggacaaagatactcaaaaggttgaatgggaaaatctatctcatagccggtaatcatgacatgaagaacttgaggcagaattatacaaaatatttcgaactgatcacgatgcagatgtacatcgaggtggataaacagaagatttatctgaatcattgcccgttcctttgctatagcggctcatacgatgatacctggcagcttttcggccatgtgcatacaagcaggaataacactggaaaagataagcctcgccttcaaatgcttttttctacacaatatgatgtgggagttgacaataacgacttcactccggtttcattcgcacgggtaaaggctatcatagagaaacaggttgaactatcaaagaaatgagaatacgatacatgagtgatctgcacctatgcccacttttcaggtatttgcgccttgtcataaagattcggtgctgaacagtgcctttgcgagtaactatggagacttgataagcaacaaccggattgatgcctggatatacggtcattcacatacgaatattgatgcagagattggtggaaccaaagtattatccaatcagatgggatatgttttccagaacgagcatcttatgaatgggtttgattcgggaaagtatgaaaataaagaagatttttttcgggattggcattcattcaacccgatggaaacacgctggtttcatgtcgcttcttccatatacatggagggaagggcaatccggtttacagaccggaaatatacccgtttcgttgtttcaaattattcttcgtatgtttcggataataatgaatactataacgatgaatggcgcagggaaactattacccgtatttttgcctatctgcgcagactggtggatgccgttattgccgatgctgatggcttcaatgaatatgtagccggcaatcttccatatcagcaacggacaggaaagatagcacggaaggattttaacaggatagagccgcgattcaggattgagtcgaaagacagggaaacttccataaaagctttggaagattccgtgaacggacgttctgtgcctccattagagactatgaaggtagactaatgtcatatttcatgtgttaacgcacatctggcaatccgtttggttagtcagtaacatgcaaattatcggcactgattcgaaatagtgccgataatttgcataattctgatatttcaaatatgacttaatcaaattctaactaacaggcattgttcgatgcaatagaattccctacgatagatgaaagaataagaaatctttctaatatgatggattggatgagatatcttccatcagtttcattaggtggagatcaagaatcgtattcaataacgaaataataagttatagagtaatggtgtaagattctattagcatatcgaggataatttcaataaacttggagttcgttgataataacttctagagttgctgaaataattaacgaggatatttttctaacattctaaacggaatatcatttgtagtaacttcagctatagatattttgtttatatttagctgtatatcattattataatatttgtatgtattcgcaaataagagatccaaacagcttaatgaaatgataattgtcgatgagcatgtttacatcactgattatcagtgacaattcaatttaatcggtacaacctttgttttgacaaatacacagaacgtggggacaaatgcagaccgttgtatttcactgttttgcatatacgtgttgtaccgtcttttttcagcccttttgtggaatgtcctttgtcagatacaaggtattgagtgataaggtatttccgcaggtatgttacagaacgttgttgaatacagaggtagtggttttctttggatttctgtggtttgtggtatagtttttattttccaaaaggtgttggatagtagaaaattggtcatagaaccagaaaacttttgtagaatttacatttgattcgcttaaaaaagtgtagggaaatgggtgatattcgtttgggaaagtgtaaaaacatatgcgttgtacttgtcttggccttaatataaacgactcaagctttcttaaattataccctgtctaatataattgtgctgtcgaaataataaattatacccatgctgatataatatcgaatatttgtgctatctttgtacccgaaaaggtataaagtatgatgccatgaataatctttcaactacggtcaaaatgttgcgaaagcaatataagctgacgcaagaggaactctcgttgaagtcgggtgttgggttgcgctttgtgcgagacctcgaacaaggaaaggaaacgttgcgccttgacaaagtgaatcagctccttgactttttcaattatgaaatggttgccacacaaaaaaataataatcaatgagacaagcccatatattttacaaagaccaattggctggtattctgacagaaaacgatgccgggtatgagttccgctatttaccggaatatatctctcatgaaaaggcaaaggcggttagcatgacattgcctttgcaagacaaagcatatacaagtcctgtgctgtttccatttttcgacggtttgattcctgaaggatggctgttggatgttgcattgcggagtacagacatcagtattcttgaccggatgtcgctcttgctgacatgctgcaaggattgtatcggagccgtaagcgttattcctttggaagaaaaggagggaagccatgtgtaattgcttatattgttatcgtccgctcttaaaaggggaaaaggatatgcacacagcttgcataaagaagttcttcggaacagcaacactgcctgttcttgattatacgacagaacaacttgatcagcttgctctgcaaatcattcaagaccaaacctctttgaccggtgttcaaccgaaattatccttgcatttgaaggaacatgagggcagcaaacgattgactattgtcgggctatggggcggttatatttgtaagccacagacctcgcaatatgaaatgatgcctgaggccgaggatttaaccatgcaccttgcagaggtggcacgtattgaggtagttcctcatacgctgatgcggatggcagatgatacgctatgctatcttacccgccggattgacagaacttctaccggagagaagattgcgatggaagatatgtgccaactgacagaaaggcaaacagagcataaatacaaaagtagttatgaacgtatcggtaaggctgttttgaaatactcgtctttacctaaaatggatgttactaatttcttagagttggtgcttttttcttggttgacagggaataacgatatgcacttgaaaaacttctctttgtatgaggtggcggatatgatacgtttgactcctgcttacgatttgctaaatgctactatcatcaatcccaatgatgatgaagagttggcattaaccttgaatggtcggaagaaaaagcttcaaagagaggattttattaggtcggcagccacgctgggtatagagaatgtgattgtagaacgactgataaataagtatattaaactattgcccaagtttgagactgtcattcaaaactctttcctaagtgctgaattaaagaaaaaatatggcaatttgttgaaggaacggcttgcgaggctttcgcagaggctataaaacggtaaaaatacacaatgctatggatatattaaatctcatccaaataacatcattgttcatcctaactttaatagaaagagacgatggacaaaagaaacaaattgtggagacgccaacaaatggctcgtgtgtttaaggctcgtatgattctgtatcccgcttatggtcattgcatcattcgtgaggatggaagctattatgaacatcctcattggtttgagttggaaaaagacaaatgggcgcaagtctacaaaactacaggaactccgtgtggttgctggatgtgcagaggatttgaatatgaccgcaaggagtataagaaagaaactttgcgtattattcgggaatcaatggagtagtttaaagggataggaactaaatctgtgcattatgtgcacaggttcagttccttgcttttcatgtaggattaagaaccactaccgatattcagaataaatatcttgcaatgtatcataaaatccccatccacaattcgatatgctatcaataagcttttcaatccgttcgtaataattggctaacaatagcataaaaagaaaagccactggtttttagcggctttcttctaattggctatggttgtttatggctgcttacaagccatcattttccgatgcaaaaataccgaaatatattctgcaacacctgatccgtcgtaacctctcctacgatatccgataaatggaatatacactcccgtaaatcttgcgagatgaaatccccggaaaggctggagttcaaaccttcttgtaccctatgtatagcttccagcgcatgcgtaagcgcctcgaagtggcgggcattcgttacgatgatgtcgctttggtggagggtggggatggaagatacttccgtgaggagttgttgtagctctgcgatatgcagcttgcctttggcggaaatagcgatttgatgccagccttcggtggggaaagagaaggttgggagagaggatgtgggtaatacatcgcatttgttcatcgctaagataacagacttattcgttaatctcggagctatttcttgatagaaagcctcgaaatccttgaggtcacgggttaagtcgtacatgaggatgacgatttgcgcttggtctagagccttgaaactacgttcaataccgagagcttcgatcgcatcgcttgtttcacggataccggcggtgtcgatgaaacggaagagctggccgttgatattgatcgtatcctcgataacgtcacgggtcgttccgtggatgtcgctgacgatcgctttatcctcgttcaacaaggcgtttagtaaagtagatttgccggcattcgtctcaccgatgatggcgacgggaataccgtttttgatagcgttacctacgctgaaagattgggcgagtttggagatgacctgttcgatatgatccgcaagcgtgcgaagctcgctacgatcagcgaactctaattcctcatggtcactgaaatccagttccaattccatgagagaggtgaaatggagcagttggtttcgaagttcggcgagttccctactgaaaccacctcgcatctggcttagagccaaacgatgttggccggtcgaagtggaggcgattaaatccgcaacggcctccgcttggctaaggtccatcttgccattcatgaaagcacgttgcgtatattcacccggttgcgctatacggcatccgctggagataagggattgcaggatttgttgttggatatacgtcgagccgtggcaggtgatttccaccgtatcttcccccgtgaaagaatggggggcacggaaaacagcggcgatcacctcatctatggtttcgtcattgttaccgacgatggaaccatacgttaaggtataagccttttgggtagataaactcttacctgccttcttcggccggaatatccgatcacaaatcttgaaagcatccggcccggagacacggaccactgcgattcctcctactcccggagctgtagatatagcgcaaattgtactcattccgtctattaaaccgttattaattcatacgcttgagaacccagtccgatttcctccgcataacgtaggccggcttgccagttcgtatccggatgaatcaaatggaatttatcctctccctcaaggtgttcgtgaggatgagtctcggctaatttattacctccgatgataggagcgttgataaccatatcggcgcaagccttatccaaggccaccggatcgaaagacgcggcgatccccaaatcagggatgatggcggcatcgttatgattccagcaatcgcattccggagatacgttcatgataaaactaacatggaaatgaggcttgtctgctaatacggctttcgtgtactcgtcgatcttgtaattcaatcgctcggaagtatcaccttcgcccattacggcaccgtcgtactggcaaagagccacacattgcccgcaacctacacaacgctcgtaatcaatttcggcctttcggttgttattcaaatggatggcatcgtgagcgcagtgctttacacagatgttacagcctttacaagcctccgtatcgatacggggttgtgaggcacaatgtaattccagtttaccgcctatgctggcgcatcccatcccgaggtttttcagcgcaccgccgaaaccggcttgctcgtgacctttgaaatggttcatggaaatgatgatatcggcatcggcgatagcggcacctattttcggggccttgcaatattgcccgtcaatctcgatttcccggtagtccgtacctttcacgccatcggcgatgataacgttgcaaccggcggacatgggattgaacccattttccatggcgctttgaagatgatcgacagcgttggagcggcggcccgagtataaggtgttgcaatcggtaaggaacggtttcgcgcctaattcacgtaacaggctcaccaagcgagcggcgtaattaggacgaatgtatgccaaattccccggttcgccaaagtggatcttaatggctacaaattgatttttgaagtcgatattggcgataccggcacgttttaccagacgttccatcttatccagcaggttgctgctgggggtcgtgcgtaaattagtaaagtagactttggatgtattcatctttttattggtttagtgttgacaaaggtacgaaaaacacggaacattttttatattcgcgtaaaacagatttgtatatggacttgcttcagcggaatcatcagctattgttgaaaggaataaattgtacattcctgcgttatttgcatgcacggatagagtgggaggatcggttaatcggcatcttcggctctcgaggggttggtaagactaccttgttgttacagcatattaagttgaaatttgaagattcacgggaagccctgtatgtgaatctggatgatttctggtttgagacacattcattgaccgatgcggttaaggagttcctgcaagccggggggcattatttgtttttggatgagatccatttctattcgggctggatggaagaggtctcaactttattggatgccaaccccgccttaaagattgttttcgctaccacttctttgtactcgcagacagaggtgcggaacgggttaaggcatgaggctgctttttataccatgcatccgatgtcgttccgtgaattcctttcttacgaaagcattctggataaagatcccattccgttggaggatatcttagcgaaccatcatgatttggtgaaggagatcaatgcggagatgaatattgtgccgatttaccggaactatctggaacatggatgttatcctttttattggcaagacccggatatgtattatttccgtctgcaagaattagtgagaaaagagatttgccgggatttgccttcggtggtttctatttcgatgagtaatctggaacgagctcaaaaatattttatgatggtggctgagtcggctcctttacgtccgaaatcgattgatgtaacccgtaagataaatatgcttcgtcagcaaagcgatagcctgttgcgtttcttccatgatatgaggcttatttattactcggcagaccaactgggaaccactccggccaagcagaaagtctttatgggggataccaacttgctgatctcttttttcggagataaggagaatcggcaattgatgtgtgaaacctatttcttaagccagatgcgttccgtggcgaacgtggaattcatggcgaacggggatttcttgattggcggtaaatatatcttcgccgtaggtgatcccttaaggggatatgatcgtctccgcttcgtacccgacgcttatgcggctatctacgggttaccgaaaagcgtgtttaaccgtatgccggcatggatattaggatttagttattgagaatttaaaaataggattgctatgttagaatgcatgaagaatagaagaagtatccgtaaatatacggatcaggatatcccggagtctttgctgaatgaattattggaagtggctactcgtgcctcgaatacaggaaatatgcaattgtatagtgtcgtggttacccgcgaccctgcgaacaaggagaaactggctccggctcattttaaccagccgatgattacgggggcgcctgtcgtacttactttttgtgcggacgcgaaccgttttgttaaatgggcggagtgcaggaaagcggaggccggattcgacaatttgcaaacgtttatcgcttcgacgatagatgcgatgttgttcgcccagagtttctgtaatgccgctgaggaaaaaggcttaggcatttgctatctgggtacgacggcttataatgcggaccagatcattgaggcgctttctcttccccgtctggttgtcccgatcgttacggttacggtgggttatccggcagagcctatacccgctcaagtagaacgtttaccattggcggctgtggtacaaaacgagacttatacggactttactccggcttccatcgatgccttgtatagagagaaagaggcattagaggtgaataagcagtttgtaagggagaataataaggaaacactggcgcaggtctttacggacgtacgctatacgaagaaaaatagtgaacatttctccgaggtgctcttgaaggtattgaaacaacaaggattcatgaagtaagccctaatacttctaccttatagttcataaagagtccactctcgagtacgcccgtaatcgacttgagagtggattctgtattttcagggatatagtccatccatatgtctaggatcatattgccattctcggtatttttattttatcttccttatgggagatctgattcccccattccaacgtattgattagcgaatgatcccacttcatagtcttgatattattatatacggtctaatacagtttcaatcagtttctccaaagaacctttataatccgtattcatatgattatccacacgtccggcgataatacagcatacggtcattgcccggtgtcccataagggcggccagacctgctaaagaggagctctccatctcgaagttcgtaatctttcgcccgttgtaatcgaaagcctctattttccggttcaattccggatcggtcaagggcaatcggagctcacgtccttgcggcccgtagaagccattggctgcgatagtcgttccccggataatatcattacgggtgatttgctcgatcaacgatggatctgccgatacgacataaggccatatgccgctaagccgccaatcaagctgctttattaattcagactccaagtccgcgtcacgaacggtattactatttgcgtagaaataaatgaccccgtcgaatccgatcgatttctccgctgccacataagtcccgatcgggacaaatggctgtaaccctccggaagtcccgatacgaaccagggaaagttgcttgaattccggcttgatcgtacgggttgagaagtctatattagcgagagcgtctagctcatttaatacgatatcgatattatctgtgccgatgccatgggatacaaccgtgatacgttttcccttgtactggcccgtgatggtatgaaactcccggctggaaacctcacattcctgagaatcaaaataggaagcgacggttgtaacccgtgcgggatcaccaacaagtaccacacgatccgcaagttgctccggttttaaatgcagatggaaaacactgccatctgaatggatcgctaattctgaagcggggattgttctcatattcaatcagataattaagtttatattataatcatgaaagggcaaggtatgaaccctgcccttggagatagttctatttatataactattttagtcctttaatggttttgatggagcaccggtcggtttagctatcgcttcacgcatagaagtgtccgcctcgatgttcttcatcttgtaatagtccattacgcctaggtttcctgtgcggaaagcgtctgccattgccttgggaacttccgcttctgcctcgatcaccttggcacgggcttcttgagctttcgccttcatctcttgctcgagggcgacagccatcgcacgacgttcctcggctttcgcctgagcgatattcttatccgcttgagcttggtccatttgcaagaaagcgccgatgttcttacctatatcgatatcggcgatatcgatggaaaggatttcgaaagctgttccggcgtcaagccctttgcgaagcactaattttgagatggaatccggattttccaatacagtcttatggctttcggatgaaccaatggaagatacgataccttcacctacacgggctaagatcgtctcttctcctgcaccacccactaattgcttgatattcgcacgaacggtgacacgtgccttggcgattaactggattccgtctttcgcaaccgctgttaccggaggggtatcgatcactttcggatttaccgacatttgtacagcctcgaatacgtcacgtccggccaagtcgatagcggtagccatctggaaaggaaggtcgatattcgcttttgaagcggaaaccagcgcatgcactactttctcgacatgtccacccgctaaatagtgcgcttccagctcgtcgcgtgtaagcgtctttattcctgccttatgcgcttcgatcatcgcacgagtgatgatgtagggaggaacttttcggatacgcatcaagaataactggatcaaggagatattgactcctgatactttggccgagatccataacaggaacggcacataatagaaaaagattgccagcagaagtactgcggcccccaataggataagtggcaaaaaggttatttccatatataaaaaattaagcgtgaatatttgtttcttctttaggacggacaattacgttgtaactgtctaccctgatcactacgatcggcgtgttctcatcgattaattcgtcttgagatttcgcttccacgttaatacctttaatccgggccttgccgataggggctaagcgtgagagcgtgatcccctcgtctccgggttctattccgagatccctgctggatgtcagcttggaatcgatatctgtctttaaagcgatcttgttaaaagaccgggaacgcaataaccaagcgaagattattccgaatgtaatgattgataaggataaagtcagatgccctacccatatacctaccgtataagcgaaaacgactccgccgatagcgaaaatagccccgcctatacccgcaagtgttattcccggaagaaggaatatctccgccagtatcagtaggatggccgctaccatgaggaagacgatgatggctatgtccagtagcatagttcttcttatttatggttgtttcttaggtatacgatctctgcgttacgtgcctttttctcccattcgtccggttggccgagcaggttgtttaatttttcttccgcatcaagaatcgtaggcttcagttgttctcgcttcgccttgttccctttgatgtagctggctcgtaagctctctagtttctcatttaactccttgatctgtttatggatggaaactactttctcgtagtagttcttcgcttccggactttggatatcgtccaaggtgtaataaacgatatcattatggatcgggaacgtgaaatctttctttatctctatacgtccgtaaggaatctcggtatgagctaaatgaataagctcttcgtaattcgatccgggtttccatgaatccttgatcgaggcaatagaggcccgggcacgttttagttcgatatcctcgctatctactcgctcgcggttgtcattcggaatgaataggtatacacaaacttttccttccggttgatagcggtcggaaacgaaccatcccaattgcttagcttcgtcgatcaccatcatgtaatcgttaaacggggagttatagggcatgcccaattgctccggtgtaagataagtatcggaattgatgttgtaacgagtgacgaataaatcatatccgcccagagagccgttccctttggatgcgtaataaatcgttacgccatcggatagcacgaatggatacccatcgtcggcgtcactattgatattcattggtaactgtttctcgtctccccattgatccatgagcttggattgggtaaaaagacaattgtggttaccgtctgtcgagtgggcgtaataaatcttatcccccttctggttcatgtataccgacgagttgcccgggtcgttagtctggaagaaatcttggtaagtggtcaacgtaccgctttcctcgcttaaggtataggctgataagaaatcatctttatcaacgaccaagctatcgataatctggacattctctaccttatcaagcatacggcttgctttgttcgccaagtccatacggatctggtaaggttccacatcttgtttcttttttgttaggagggtgatgtattcgtcgaacatctcctcggcttcgttaaaacgataggtctggtagtatacttctccaaggtatcgataagcgtcttgtaccctacgctttacggcgaccttaagatgtttctccgctcctgctaaatctccggtctcgaaacagcaaacaccataccattgattataagaggcattgcttggcgcttgtttcactagtttctcgaacacaggtttggcttctgcgtatttcccgtcgttatataatttttttgcctgatcaagactttgcgcatgtagttgcattcctccgcatatgagtgtaactcctagcgtataaagcagctttttggataaccgtttcattttgtctattctagattatatatagttatgcagtttcaaagataagaatatttttgtagaggcatacaaatcgaaaagataaatatataattttgcgcccgtaaaggaagtatatggcaaaattgacagaggacgaacgtttgtttcgcaagatagaggataagataaagagagcgattttcgactatggcttgatcaatgatggcgaccggatcttggtcgggttgtccggaggaaaagattccttggccttggtggatttactggggcgcaggtcgaaaatctattgtcctcggtttgaggtcgtggtagcacatatcgtgatgacgaatatcccttattgttcggatcgggaatatcttagaagttgcgcagaggagcatgatttgcctttcattgtccatgagacaagtttcgatccttctacggacactcgcaaatccccctgctttttatgctcttggactcgccggaaagctttgtttgagatcgctaaggctcataaatgcaataagatcgctttaggccatcatcaagatgatatccttgagacgctgttgatgaacctgacccaccaaggggctttcgggacaatgcctccccggttgagaatggataagtttgatatggagattatccgtccgatgtgtctggtggaagagagggagttgattcaggtcgccgcatggaaagggtaccggaaacaattgaagaactgtccttatgagtcgggttccagtcgttcggatatgaaagagctgctgagaagtctggaagcgatcaatccggaggctcgttacagtctttgggggagcatgacgaatatacaagaagattatttacctcgaaaaataagataatatgcaaagtgtttatacgattttattgttgatcgtgtctaatatttttatgacatgcgcttggtatggtcatttgaagatgaagcaacagtttagctggttcgagcatcttcctttgtttggcgtaatcctgtttagttggtttctcgctttttttgagtattgtttccaagtaccggcgaatcgcatcggtttccgggataacggggggccgttcaacttgattcaattgaaagtgatccaagaggtgattacgttggtggtattcgtggccttcagtaccatcgcttttaagggggagtcgtttaaatggaaccatgcgcttgctttcgtattcttggtagcggcggtttatctggttttcaagaaataaagtcgttgcgtttggctttgataatcagcggaataccttgatgcctattgtaagatgcttacaatgcctattcaagcatgtttataatgcccattgtaaacaccttataatgggcattgttaaaacgctacatgatctgttggctcagatgtgtaaatatagcttcggtctcatccggatggaaccatgttatttctgggtcccgtttaaaccaagtcatttgcttccgggcgtagacccgggagtttcgtttgattttctccacggcgaggtctaatgtccattctccgctgaagtaattgaataattctttataacctaccgtgttcaaggaattcaaatgacggaagggataagcccggcgagcctcttccaataatccttcgctcatcatttgatctacacgttggttgatgcggtcgcataattcgtcgcgatctctattaagccctactttgatgatccggaacggacgctctttcttaatgttcgtgcggaaggaggagtaaggcttgcctgtcatccggcaaatctctacggcatggatcactcgtttataattatccctgtccacttcctcataatggacagggtctgcttcttttaattcagcgaggataggggctagtccctcggtttcaaattgcatgtatagggcatcccggatctccggtgtaaccgtcgggatatcgtcaatacctttacatacggcatcgatatacatcatagagcctccggtcattacgacggtcgggatcgttttatgtaattcggataggagggagaccacgtcttcctcgaagttgctggcgctgtaataatcggtaagcgagagagtgcctaccatataatgcttgacacgagccatttgttccggtgtaggggcagccgtgccgatcggaaggtctttatagagctgacgagagtcggaagagataatcggagagccgaaacgttccgccacttggaggcttaactcggtctttccgactcctgtcggcccaagtaatataacgagggaattcatcaaaagcgctcgtcgtcgtaaggattatccatcgggccttcgcctaaaccgtcgaagccgcttttgtctaattcgtccatatcgtattcggaatccccgtaaaaatcttctcctacgtccgtactgccgttcttagcctcgaactcatcgaaagaaactatttgggcgggaggcgtacctaccgatttgctgcaaataggagcatccaagtcttttcccggaacgatctcacgaagttccatgaagaaggcacgttcggtcatataatcgaaaacgaaaagtagtttttggtgctcgtcttccaacaattcttccagttgagtatcggccatgacatagctgtcttcctcggaagaggtatccatctccactaatgtgatctctgtctttttactccagtcatcgtcacatatgaagaaagaggtcatttgatcctttgtataacctacagagtcgaggatggcgttttgcaaatccaagaaagtagactcggaatcaatcttgatctcgcgcttgaagtcatctgcttcatctgataggattagaaatctaaatagcatagtcgtttagttttattatcgcctcaaaagtagtaaaaatatggatatacccaatatacgtcgctataaataatgaaagagggtgtgcgtctgatccctgtatgggatttttgacgcacaccctgcttatacatcatcctcgtttgtttatcgtacacttaccttcgtcgcggcatgacggccattggcggacagctcgattaggtagatgcctgccggggcgggtatgcgggtgatatcgctgacattgccgctgtagaggcaattaccggtcaccgcgaagatacggatggaaaccggtgcggtcggttctaccatgacagccccgtggataccatagacacgtatgccctcggcgatctgttcgatgcttaccgtggtggatacgcttacgtcgcaggtggcggtcttgttaccgtcgtcggtagcgaccgtgatcttgcaagaacccaccttcaaggcggtgacgattccgtcggcatcgaccgtggcgactgtctcgtcgctactgctccaagagacggactgcattgtggcgttactcggcgataccgtggctttcaaaacgaaagactcgcctacggcgatgctcttggaggtaacattcagtttcacgcctgttacacgtacgtcgggtacgaccggagtatccggggtggattccttcatcgtggcgatgattgccaaggagccttccacgttatcgatctgtgcggagttgctcgtgtatgacttttcaccgatctgcaaattctccagttcatagcccttagccggttcaacctccacgatcagcttgctgcccggggcaacggcggtgccgctgttgatctcggtctgctcgccgctctcgtctacggtgtagactttcagcgttccgttctcgggttgctcgaaggtgatgacagaggcgccggtgctcttcactgttaccttggcgtttgtctcgttgttcgaatagttcggatcgtaagaggtgaactccaccttgtaggattgatcgtcacctacgcccgggatcttgttaggctctgcccattcgaagataccggctacggtcgtaccgtttgttgaagctgttgaagccacgccaccggaaaggatggacgcgctcaaaggttgtccctcggtcagctcggaagcggtaagggtggtgaatgagttgatcgtagcaggcttgatcaccaatttaatattcacgtcatagaactctttccactcatcgttaccggcgaagcttacattgaccatataagttcctgcgttcatcggagtggcggaagatccgtcaacattcgcatatttcaatacgatctcattctccggaagaccggtctcgttgaacaattcagacaatgagactacttggatcgcaccatcgtaagacttttcaatcaaacggttcttaatggagagtgtctttagggcctcgaataccggagtatatgtagcgtcagcattcatggtaacctcacgctcgatattcgtgtcattgtcttctttccacttaacgaaccgttggccttccggagcgatcgctttcagcgtaagtttcgtaccttttgctatctctgtgcttgttacctctaagccgccgtttgttacataggtatccttagttgtcaacgttacgggctcaacatcacctactgcaatatagtaatctaccggctcatagttgttctcgtctttcggggtgaaacggatcacgttcactttgtcgttgtcaggagtacctgtagctgcagctctaagtttggatagagtgcttacagattttggattccaagctataccagcgatatcttgtgtcaactcagcggtcacatcattgccgtttaacgtaggaacactcttcagtgccatacctgccttattgatcaccaaggtagcggtctcgcttacggccttgtaaagatcatcctccggacgggtgatgtttacggtgtaagtacctgcgtcttgaggcaaagtctcacctaagcttacgccattcttcgagtaagttacctgaaagcccttggcggcgtgtccacctttcaccttcacttcgtagctacgaggttgcttgttgtagaccaaggactgctgggcagtgttgatctccagcttagtcttcccgatatagttcgccgcaatcgtcatcgggccggataccaccaaggtatcgccgtccttgatctcggaggagttcgcggtcatgctcttgaagcggtagccgctgttggtcgtaaccgtggcgactagtctcgtctgatagtttacatctgaaccggaggtgaccgtagcgttgtcttcaaccttcgtcaaagagacggaacctgcggtcgggatattagcggcggctgtcaccttgaattgagtcaacccaaagtttaccttaacattggcatcggctgtacctaccgtaaatgtattgtccgtagagctatcggctgcgttttctacgtttacgctgttcaaggcatatccataatcggccttgcagattactttcactatcactccttcagcgatagccgcacccggtgtgatcggggctttgctcttattatccagcaaggtcacgctaccatgtcccgaattgcttacgttcaccaagtgggtagctgccggtttctcctcgaaggaggcctctatcgtggcggcttgggccaaggtataggaaccggtgttcaccaaggctccgttcaccttcacggacttaaccatcatatgcttcttgtcagttggcgtggcgttgatggtcaataaagtgccttgcaagagtgcctcgccatccttcacctctacaccgttggcgtaaacctcgagcgtgccgttagccggggtaccaatatttaccttgtgtaagatagagtcgaagcgggctaccaattccagatccttcgtcgcggttaatgtacgaatggcggatgtgtttccatcgctccagccggcgaacgtatagttcttgtcggcgatcgcctcggctgctagctcataaccctcggcgtagcgatcgtttgcggaacgtccggtcaacttgaccgtaccgaagttggcggcggtaaccttcatcgtataaacaggggtaacctttacattaataaatgtatcttttgcgagataaagtatcggatcatccggcatgaacgtgatactgtattttgtcttcgtcaaggaaaccgtgtcgttcgggttcgtccacacgaacgatccagtggtaccctcgacggagccaccttgtaatacggctatagacaacggctcgccctcctcgatatatccggcgtcgggtaacttcgagatacttacctctttcttgctctccactaccaatgttgccgtatcggagaggctgcgatatgtcaaatcctccggacgggtaaaacgggccttgtaggaaccggctttcagtgtggaaggcaattccttgatccaattcgtaccattcacttgatattcgatctcgatatccttgatatcgctcgctaccgttacttgcttgatagagccttccatctgggtcaggttgttggccacgaacttcacggtgtctttcgagatgaacacgaaggtgtagccggctcccgccgtaagttcggaggtagtgtacgtgtaagaggtcttaccgtcggcatacgtccccgctatcttggagatatccacatccgaagagccttgcttgatagcccccagcttataatttgagttcgacacgatcgagaagacggcggctttgccataagcgatatcgccaccactaaccacgtctttaccatccatcttggcagtaaccgtaccatgttctcccaccgcataaaccaaggcgttggcaccggttaccgtgaaggtattcgaggaatccgtcaaggcggcgtattccatcgtctccggactgatcaagacaatcttataaacgcctacttcggcgggtaaatcctttgtctccttactattgacggcacgatacgtcacggcttgtccgttcatttccggggtaaacttgattacgggcagattctgtttcgctaccacttggtccttggtagccgaggaacctgtcaccttagcggtcaccttcatcttctccgtgaacacgacatttatcgtggctgaagcggtcagttctccggtcgtgtaggtataggagatcgtattatccgtgctattgaacttacctgtaggcaagttagcgggcttcccatcgatctttatctcgctcaacttgtagccgggcttggcggtaatcgtcaatacggcggttttgccattcacgatatcaccgccgttagccacgtccttgtcgcccatcttggcggtaaccgtaccttgttccccctctacgctccagcttaatttgttcgcttgagagatcgtgaacttgttgctctcgtcggtcaacgccgcatagtccgcggtctccggactggtagcgacgatcgtatatacgccgtcagtggcagggagcttatccataagagttccggaagcattcttgaactgatacttctggccggaaatactcggggtgaaagtaacagttggcaaattcttatcggcagcgatctcatccctcgtggcggatagcggactggccgatacggaaacggtcttctttgcggtgaactccacgttgatagacatggcagttttcaagttggcagtcgtataagccgcataggtagtgaccttggtagtagcatcgaaagtaccctccggtaaatttaccacttgattatctacggtaagcttgcccagcacatagccggacttggcagtgatcttcaacacggccggcttgtcgtaagcgatctcgcctccgctagtcaccgccgtcccgttcatggtagccgcgacggttccttgcgtcgcttcgaaagtataagtcagcgtatgggccggcagtatctcataatcgaatttcttgtcgatggcggcttgcgtggccgtctctgccttggttatgagcacgttgtactttcctaccgtgacgggtaagtccgttgtctctgttccggtagccacgttcttatacttcactgtatatccggttacatcctcgggagtaaatgccagcttcggcaagttcaccttcgctttcacctcatccagcgtagcggaagcgggagacatcgtgaccgtcacagggtcttttgccttgaatgtcgcctttatctccgtggcttttgccaaggcgggagatgtataggtgtaagtagtcgtattatccccattaaatgtgccagtcggtaacgtgccgatagtggccgtattcatggttatatccgcaagcacatacccggcattcgccgtgatcgtaaacttgggggcggtgttgtatgccacctttgcgccactcgagatgtcgctggttatcgttccgccctcacttgcgctgtagttgagcgtcaccttgaacgtcggtagatccggtgccgagcgtaaatctgaatcctgtgcgtgtacctgtattaacgccataagtgcgaggaacacggctgatattagttttctcatgttattctgtttttaatcgttacttaactcttactaattgaccgtttacggcatagataccggcgggaaccatgacgcgttgcccgtccgtggctattcccttgtaggcgatacgaccgctcatctccacgatcagtacctgtacaggttcggcggtatggatcatgatagcgccacgatcggtagtcacgtaataaccttccaccggctcaatttcctgcgtgcccgttacgatattgtcgccgaggcgcaaggaacgaagggtgctatacgttgaggcatccgtaaagatcacgctctcgaacggttttaaggttttttccgtacattgaacgaactcattgcttgcggcattcagcttatatacgtattggttcttcgtaagtgtcaactcatccgtacccgtattggcgaagatcgtgaaggtagccgtagtcggggcgtccggctcggtagcggctttcagctcgataggatctgcggcggtggacacgatcgcatactcaccagtcgttgcggagagtaaaccggcctgtccgaattcgtctgtcttgtactcaaactccggagaggaagtgcccttcaaggtagcgtaccatgcgccggtattggctttcggatccgccgtaggttgggtgtattctgttgccggttctgtcgtgctctgtactttataagtacttgggaaaccaaatgctttccactcgctgtccttcaagggtgtgttcagttgaagggtagtagctgttatcttgtctgtcgtagtcgcgggcgaagtcggaaccaagcgtgcgccttcttccatcgtcaccttagccaaggcaagcggggcggtcacgttcagcgtacccgtattctcgatgtagacattccgattggcataggtaacatcggctgttagggtttggccggcggtcacgatcagacgtttcagccacatagcgacgcctttagattcagcggacatttgtaccaaccgttcccatgaatcatccggtacgaccacgatcttctcttggtcataaagctcggaatagatcggggctttctcggcgaaagtagagttcgcgtcaaaagtgaagcaaagcgtagaatactcgggcgtacctttatcgatattgacaccgccccaagcattaccgctcgtgtgcatatcggtagcgtccaccttggagtgaaccactaagcctgcagccgtattatctttcaacgtaacgaaatccagcttgacagccatggacgtttgtacgttcaaaccgttccgtttcgcgttgctcgcggtcaggttggagatcactacctcgcccccttctgccggggtgatacctgtagcgttctcgatggcgatcatgttcagatccgcattatacgtatgcgcccaatcagcggtacccgccttaatgaccgtcttgtccattcccgcgccgttcaataccatcggtttcgtgattgtcaactgggatggtaactcataggtaccctccaccaacgcgatctcatcggcatggacactggctaaggctaataagtcgctagcgtcgagagcggtagcgtttagggtgccttgttttgtgaaggtcacgccctcggctatggaaaggcctccatccagattccaagtcttaccctcacctaaagcgaactccgataaggtaccgggaacggctgttccatcccggaagcttaccaacgaggctttggcaccactcaaattgatattcgcttgatgcaagccacggctgaacaccatcagaggagtagcgctcttcgaattgatgaattcaaaagagaccgtcccgtctacggcaggtgccggtcgtccattcgtatcggaatcggcccaacccatgatcgctcccaaggaagcgttcatgttttccggctcttggaacgtacaaccatcgaatttaaaagaggctgttcctaccgcacctctgttgatagtggcgaattcacgatctttgattgccgtaccattaatcgaagtcgggaacgtacagcctgtgaccgtagccgtaatctcatccgcacgaccattcgataacgtgccatagaaggcggcgatagtggcgttctgtatcgtgactgtcgagacaccggtatgcgtatatccgtttcctccaccacaaccgataccctcggctatcacgccaccattcatattgatcgtgactgttttaacaccatttacggattgatcgagcggagtgtcgatcgtgtttgtagtcttaccgccatcatcacctccgggataaagctgactcaccgttcccccttgaatctcgatatatacctcattcgctttcgagtaacgatatccaccgcctaccaacaaataagaaacggtggcatctttctggatttgaatagagatcttgccggtaacatcagcgggagtatctgactttgtagaatttccaccgcctaacattgttctcaccgttccactgatcatattaatagatgtggaagcaaccgtagactctttagctccaccatatatcttagaggtagaaggaaccttaaacgctactgcggttttcccttgtttcgtgattttaacagaatcggttgaataagcggtaatctcgataggcgttccattcgcgtatacgtcataagaggtacctttcggctgtcttaccgctgttatcgccgagacaagcgtaccgttattcgtgaaagtcacggcagtatcaatcactaagccgtcattgaaagtccacgtcttgtcagcagacaaagtgaactcagacagtccttccggtattttctttccatccacgaaatgtctcaaggaggctttcgctccggtcagctctatattcgcgttatccaagccacgccccacggagaaagtcggcgtctcggtctttgaattaatgaacttgtaagacacattcccgtttacgattggctgtggctttccattggtatccgaatcggcccaaccgtcaaccgcacccaaaccggctacaatactctccggttcctcgaacgagcagccatcaaaagtgaaagagatgttcttcactcctccgcggttgatcgaagccaactcacggtactggatatccgagccattgtattgtttcttaaatgtggtatttgtcatgttaaccgttatatcatcggcataaccattagataaggttccgtagatcgcacctaactcggaatcggtaaccgtaacaacagacgtacccgtatgtgtatatccctgtccaccgccggtaccaagaccttccggtatggtacatttcgagagggtcatatttacgttttttacgccattgacggatgcgtcaacatcggtggtcagcgtattagttgtctgcccttgatcatagcctccagcatagattgccatgatcgtggcttgatcagccttgatattcacggtattggtctttgcgtaataacgaccaccacccaacaataggttgctgacaaccgcacccggctttatttcaatactgacagcatcgcttacatccgcgctcacgggagtgtaatacgatccgtcactatttttatagctatatttatccgtgacagcttgggtcgttttgcctgtacccgcattgccgacaaacatgccaccaccaaatatagaccggatactaccgctttccaacgtgatcgaagcagaagtcacggctttacctaggctaccgccaaagacaccgaacttgccgggctcaaactgcaaggtatccggagtcccgccatcggtctctattgtttccacgatcatacgaccgctggcttgattcaaataaacacgaaccggattaccgtttgcgaagcaagaaggaatgctttctagagccgggtttgaaggtgtctgcggcaaaatcattttgcagagcttaccaccggatgaatacaccaatgtgtccacatcctgtccccagccactgcttgtcgccgtcaaagcgagcgcaagcaaatagagtaatttgtgtctcataagcttatgaatttaagtgttaataatgtattaaaatgaatggtataggacctttccgacaccacccgctgatgtctcgagatatcacccgctgatgtccacagagagcaccggctgatgtccggagagatcacccggtggtgttggaagggatcaccgggtgatgccggagggccgccctttagatctcatccggactctccgagtcgccgccttcgctactagagtcgttgacgggcttgatccgttcgtaggtcactttcgcccgcatgtcttgtaggatcttgccgggagtatagaccagactcggcttcttcatcatgaccgaggcggcgaattccttttccgttacgctacccttactgccgaccgcaagacgcatgctgccgaactcgcccagctggacgttgcggccctctttcaggtgacgggccaagatacgcggcaaacggtcgaaacagcttttcacgtcggcactcgtcaaggcggtctcctcggctatgctctcgcagagttcgtcgaagctgacgtttccgttggatagcatttgtgcgaaatatttcttcgcgtctttagcagcccctttggagaagtcgggacgttgaactaatttgtattttacactcataagtatttatgtattggtgaacttgttttcacaattagtactagcaagtaattatccccttgacctaacgacctttactctgtggcgatcaatctctcttccctatatccctcatcattggttggtgctccgcagcgtaatagttatggttatcaaataaaaacgactagtttaaaccaacgtttggatcttgcgtttttaggacttggaacgcaccatatatctccttgcgttaaatagttggtttataagaaaaataatcaaagaaagtgtaccgctatttgaaaataaagccttaaatttacgacgaatttaaacgttggtttagaatagccgtttttagcatatgatataatgtatgtatgtacattagtaagtattaaaatagtggacaataggtaattgtaatatgggtaaataataaaaatcacagtatcagatatcaatcttttgcatttcgtccgaaatgacatatctttacgacaccgcccgctattgggccgtaacttaaaacctatcaactatggataaaaaaaggaggatcaacgcatgaaagaattaaaagaccgatacatacgtttcgattgggcgatcaagagactgctccggcaaaaagccaacttcggtgtgctggagggttttctcacggtttttcttggagagaagattaccatcgtggagctactggagagcgagggtaatcaactgtatgaggatgacaagttcaacagggtgtacgccgaggcacttaacgacaagggcgagatcatcatcgtgaaaatataaaatattcgcaagctatattatctcgaacaggtactctatggcgtggcgaaaaccataaccgagtacatatcactgggcgaggactaccacaaggttaagaaaatatactcaatcaacatattctacttcgacatcggacggggcgaggactacctttatcacgggcagaatcatttcatcggcatacataccaaggatcaattggtagtcaacacgaaagagaggagcgtaattgtctccaagctatcccccgagattttccccgaatatatactcatacggaccaataagttcgataagatagccgtcactcccctagaagaatggatggactaccttaaaagaggaacaattcgtcctgacaccatgactccgggattaggcgaggctcgagaaaaattgagatactactccatgacccccgaggatagatacgcttacgacgaacacctgaatgcggtcatgatacaaaatgacgtattggattcggcgaagcttgaaggatacctggaaggactagcggaaagtagagcggaaaataaggagaaaggtaaggcgaaaggactggcaaaaggcgagacagaagcgaacctcgaaaacgccaagaagatgaaagccatggggatcgatcttgaaatgatccggcagatcacgggaattaccctataaataaccttttggtgacataaatagcgaatcggcgcaaacccctcatcgtaagatgtggatttgcgccgatttgtttttggttgtccggatgtttgtgtcgcttattcgtcgatcgaacctcttacgataccccggctggaagacttgatgaaattgaggatcaaatcccgttcctcgctaggctcgtactcggtctcgatcgctttcagcgcctccgtattattcaagcctcgggtatacagcgtgcgatagatgtcttgaatcaagaatacctgctgattcgtgaatccccggcgacgtaaacctacgatattgataccgcaataaacgatcggatcacggccgatcaaggtataaggagggatatcttttccgatacgagaaccgccttgtaccatcacgtgcttggatatacgcgtgaactgatgcaccaaggaacctccgcttacgatagcgaaatcatcaatctctacctccccggcgatttgcgaagcgttaccgatgataatatggtcttttaagacgcaatcatgggccacgtgcgaataagccatgattaagcaattgcgacctaccacggtcttacctttggaagcggtaccccggttgatcgtcacgcattcgcgaagcgtcgtgttatctccgatttccgccgtcgtggtttcccccgcgaatttcatgtcttgagggataccggcaacgaccgctcccgggaaaatattgcaatttttaccaatccgtgcgccatccaagataacggcgtgagaatatatatggcaattatcaccgattacgacatctttctcaatcacggcaaacggatcgatagttacattctggccgatttgggcctctggatgaacgactgctagaggagatatattcattatcgtactttatcttattatttgttttttacaatctgagccatgaactcggcttcactaaccaatttatcaccaacgaatacataccctttcatggtagagatcccgcgacggatcggtgccaataattccagacgtaagatcaacgtatcgcccggaacgactttttggcggaatttcacgccatctattttcatgaagtaggtagaataacgctctggctcatctacggaattcaagactagcaaaccacctgtttgtgccatagcctcaacctgtagaactcccggcatgaccggctcctgagggaaatgcccttggaagaacggttcgttggtcgtgatgttctttacgcctacgatatagttcccgccaacctcgatgatcttgtcaaccaataagaacggatagcggtgcggcaataattcacggatacggttgatatccatcaccggctcacggttcggatcgtataccggggcttgcacctcgttcatcttgatatccttgcggatcatacgagctaactggttattgatcttatgtcccggacgggtagcgatcacacgtccgcggatcggcttaccgatcaaggcgatatctccgatcacgtcgatcaatttatgacgtgccggttcgttatcgaatacaagcggcttgttattgatatagcctaattcctgcacgttcttgtgagggatgttcagcatatctgccaatttgtccaaagattcttgcggtatcttttggtcgtagataacgatcgcgttgtctaaatcgccacccttgatcaagttattgttgagcaacatctccacttcgcgtacgaatacgaacgtacgtgaagccgccaattctgtcgggaattcgctgagatcgttcaacgtggcgaattggttggaaagcacgggcgaatcgaatgagatcaatacgttcacgctgaacttatcatccggaaggatgatcaacgaagaaccggtttcctcatcttttacctcgatcttgtgctttacgatataataatccttcggagcgttttgctcaacaacccctgtcttttggatttcctcggagaagaagcgagaacttccgtctaggatcggaaactcgggtgcgtttacctcgatcaagcagttatcgatctcataagcgtataaagccgccatcgcgtgctcgatcgtacttacttgaacgccattcttgctaagcaccgtaccccgttgtgtattaaccacgttctcggccaaggcgtcaatcgtcggttggccttccatatcgacacgtttgatcttgtatccatggttctcgggtgcgggattaaacgtaatctctatatctaatccggtatgcaacccttttcctttcaaggagaaacttgccgcaagcgttttctgtttttgcataggtctttattgtttattaatttctttcttgagttgttcgatctcccgttgcatttgccccagcgagcggtatatatccggaagacggttgaagatcgcgctggaacgcatgaagttcttagcgttgatcgccggcgccccgagcaatgtcgtcgcttccttcacgtcgctgataacgccagcctgagctccgaatacgacgtggtccgccacatggatatgtccggccaaaccaacttgtccgccaaacatacaatgctttcctacttttacggaaccggcgatgccgacttgcgccgccatcacggtattctcgcctacctccacgttatgagcgatttgtacgagattgtccagcttaacgcctcggtgaatgatcgtagaatccatcaccgcacgatcaattgtcgtattggctccgatctctacatcatcctcgataataacgttgcctaattgcgggattttcttgtaagtctcaccttcgggagcgaatccgaaaccgtcagccccgactacgctaccggcatgaaggatacaattattgccgattatacaattctcgtaaacggtggcatgcggatagaatacgcagttatctcctaccgtcacgtgatcaccgatataagcgtgcgggtataccatacagttcttacccatttttacgccttctccgatgtaggcgaagttaccgacataacaatcgtcgctcacggtcgcggaagcggcgataaaagcggtagaatcaacccccttctttttgctcttcgattgctctaccaaatttaataacatcgcgagcgccgcataagcgttctctacttttacaagtgtggctcttatcggttgttccggtttgaaatcattattcaccaaaacaatgcttgcctcggtattataaatatgatgcgcatatttaagattcgccaaaaaggtcaatgtacctggctttccttcttctattttagagaagttgctgactttaacgttcggatctccttcaatcgttccgttcaggaagccggcaatttgttgggctgaaaactccattacttattcaattatatatgtatcttcgttgactgtccgctgtttatagacagttagtttgcaaaaatggtgaaaattctttatatagcctatgctttgcagggaataattcccttatcatgtagataaccggccatttctttctgtacggcatgtgccgcctcacgggctacgttggcgaaagcctccgtcttatccgcgtaaataatcgcacgggaagaatttaccaaaagaccgcattggtcgttcatcccgtattgagctacttccgccaagcttccaccttgagcgcctacgcccggaactaacaagaaatgattcggggcctgtttacggatatcaaggaacatcttgccttgggtagcgcccactacatacatcatttgctcatcgttagcccattcttgcgatttctttagtactttctcgaaaagacgttcaccatttgcgtcttccgtcatttgaaaatcatgtgagcctttattggaggtcaaggccaataagattacccaagcctccgggtagatcaagaatggttttacgctatcctcgcccatatagggagcgaccgttacggcatctaccttgatatgatcgaagaaagaacgggcatacatctcggaggtatttccgatatcaccacgtttcgcgtcggcgatgataaattgatcgggataattctcccgtaagtaagccacagtcttctcaaaagccatcataccctttgtgccgaggctctcgtaaaaagccagattcggcttgtaagcgacacaataatcggcggtagcgtcgatgatcgctttattgaacgcgaaaataggatcttcttccgacaatagatgttgcgggatcttttttatatctgtatctaatccgacacaaaggaaggattgtttctttttaatattctcgaatagctgttgtttgttcattttcttattcagtatgaaatgattggatgtgtttacaattcagactctttcagtcgctcagcgttctccgctacgatcaggtgatccaagcaatcttgaatttcaccgtccataaaggctgaaagattatagatcgtgtaattgatacggtgatccgtgatacgcccttgcgggtaattgtacgtacggatcttcgcggagcggtcaccggtagataccatggtcttacgcttgctggcgatatcgtccaagtatttctggtgttccttgtcataaatgaacgaacgaagacgggtaagcgccctttctttgttcttcggttggtctcgtgtctccgtacattcgattaagatttcctcactcacacctgtaatggggttcttccagacataacgcagacggacacctgattccaccttgtttacgttctgaccaccggccccaccggagcggaaggtatcccatttaatctccccttcattaatctcaacatcaaattcatccgcctcaggcaatacggcaactgtagcggcggaggtatgtacacgtccttgcgtctccgtagccggtacacgctgtacacggtgtacaccggactcatacttcaacgttccgtatactttctcgcccgataccgtgaagatgatttccttaaaaccgccggacgagccttcgctaaagctagacacgcttattttccatcccttcagttcgcaatacttcacgtacatacgatatagatcaccggcgaaaagggcggcttcgtcacctcccgttcctcctcgtatctcaacgatcgcgttcttgtcgtcttgcggatcagcgggaacgagcaataattttatctcttcttccaaagcgggaatacgttcgttgcaggtatccagctcctcacgggccatttcccgcatttccggatcttgctcggactcaagcaaggctttcgcttcctcgatcccgttcaatactttcacgtattccgaacgagctcccacaattttctccaaatcacggtactctttgttcagttttacgaaccgtttcatgtcggcgatcaccgccgggtcggtaataagggtaccgacttcctcgaaacggctcactaatccgtctaatttaccaagtaaactattttcggccatttatctttattaataggtgaagcgacctttctcgctttcgataatcaattcatttttatcagcttcctctacgaagcccacgatttgcgcatcaataccaaagctttttgagatgccgattacttcttccgcatgctcgggagcgatgtatatctccatccggtgtcccatattgaataccttgtacatctcgctccagtccgtaccgctctgctcctgaatcgtgcggaataacggtgggatagggaagagattgtccttagttacacgcttgttctctacgaaatgcatgacttttgtctgggcccctcccgaacaatgtaccataccatggatttgagagcgtagtttatcaagcaataccttaattaccggcgcataggtacgtgtaggcgaaagcaccatctttccggcatcgatccctaattcctcgatcttatccgtaagtttcaatcctccggagtaaaccaattcttcgggaacggcggcatcgtagctttccggatattttttcgctaaatacttagagaaaacatcatggcgggcagaggtcaagccgttgctacccatacctccattgtattctttctcgtaagtggcttgtccggaagatgccagacctacgatcacgtctcctccttggatattcttattatcgattacgtccgaacgtttcatgcggcaagtgaccgtactatctacgatgatggtacgaactaagtcgccaacgtctgcggtctcgccacctgtcgcgtagcaaccaacgcccatctcacgtaactctgccagcaactcatctgttccattgatgatcgccgagatcacctcgcccggaaccaacagcttgttacgtccaattgtagaagagaccaagatattgtctacggcacctacgcagagcaggtcgtcgatattcatgataagagcgtcttgggcgatacctttccacaccgaaagatctccggtctctttccagtacatatacgccaaggacgatttggtaccggcgccatccgcgtgcataatattacaatattcaggatcaccgcctaagatatcggggatgatcttacagaacgctttcggaaaaattcccttatcgatgttctttatcgcattgtgaacatcttcttttgaagcggaaacgcctcgcaggttataacgttgatcactcattgtactatattatttgaaccgcaaaggtaatacttttttatgttacttatctaagttttaagacatctccttcctccgggatgtaatctttgtcttttttattcattttatacagactcttgatctggattccgtacatctgcgcaatactgtgcatagactctccgacttgtaccacatggtcgtaattcggcttgtccgctttcttctttttcttttccagatatacgatatcgcctgcctgcaacgggaagtcctcaggcacctcgttgaatttcatcaactgcttggccttgaatcccatgcttcgggcgatctggtcgaaactgtcgttatccttagcgtatacatagatcaaaccgtgggtacgatagacttgataattgaacaccggaagattttgcttcttggtagaggtcttcttttttctcttaccggagtcaaagcggtataactcataatcttcgataaccttgattaatttattcgcgtaagcacgatcggtggcgtaaccgcatttttgtagtcctttggcccagcctttgtaatccttgatgtttaatttgaacaggcgttcgtagcgggagcgttcggcgaggaagcgggaatggtcatcataagaatcctctactcgtttgtatttccggaagcactctccccgcaggtcgtcgtcgtgatagaccctgccgcctcgccagtccgaatggcatttgataccgaagtgattgttggagcgtctggccaagtcgctttgcccagctccggattccagtaatccttgcgctaaggtgatacttgccggaatgcgatatttcttttggtgttgaatcgccaaatcactgtatttactgatgtatttttgataggaagtcagcttccgctggctttccgcccctgcgcttaaacagacgagggacaataataatatacctaaaaaatgaagggataaacgcataactgttcttttcgatccgattttaccggacaaatatataaaagaaaatacatatctaccgggaattgatgggttaaaaataggagatacgggctagataatcgtaatgctccccattttctattttttccgctttaaagccggcttgccttgcgtatagattcagcgtgttgaaatctatatataaccaatcaaatgaatcccctttgatacttttatattgcatgcggaaatcgatctctccgaaataatcatcctcgggggcgatatccagattcccgtcttcatcttcaaataaataacttaagtcgctagagtcaagtaaaagctgtccgtcccgggctagaacctcttttaagcggtgaaagaaagccgggagattttccagtttaccgataatcccggaaccgttcattaagagaagaatggtatcgaatggtccggttaagctcctgtcaaaaaaattctgtaagcgggcgtcttttacgccccgtttgttcatggcctctacggaaagaggggatatgtcgatagcggtaacctctttacccatttcctgtaaagccaaggtgtggcatccacttccggcaccaacatccaatattttgcctgtactgagttgaagggctttctgttccaaggagggcatttcttggaaagtccggaataattgattcacgggaatctcatcttcatcgaacatggaggagaatacacggagtttactcgcttttccatgtgcgagataatcgatgatagcggcgcccatcgggtctttatcggatgtaagaagcattgaatgcatatgtctttattctatatataaggtatattctatgatgtgggtgcgaaattaatatattctttttatatttatagcctataagaattatagttatgtttctttcaaaacattaaaacaatcaagaaaatgaaagaattgaaattagagacccgggtagaggtctatgcggtaggagaattggacaatatatataggcaattgtacgaggccgcttttgaagcctcgaaaaaagcttatgctccttattccaagtttcatgtgggagcggcggttctattggagaatggggagatactttccggaaataatcaggaaaacgcagcctatccgtctgggctttgtgcggagcggaccaccttattttatgcgggagcacgttatccggatgcggcagttcagattttggcgattgcggctatgaaggatggggaacgtgtggatcttatcacgccttgtggtgcctgccggcaagtgatgttggaaaccgagcaacgttataacaaacctatgaaagtccttctttgtggaaaagaggaagcgtatctcgttccgagcgcaacggccttgttgccgttttgtttcagtaagtctgatttgatctgatagaataaaaagaggcaagaacgattctcgcccttgcctctatatgtaataattaagttcgattagatccctaaagaagccttgatctgattgatcttttcttctgccgctttctctgcctccggcaattcatcgatactctttaccttggagtgaacctcgcaatagaatttgatcttcggttctgttccggaaggacggatagatacttttgtattatcttccgtgaagtattgaagcacattagaggtagtaggcatatctaatgtaacggtttcgttctctgcatagtccttacctttcaatgtagagtaatcgtagaaataagttaccttagagcctgcgatctctgtcaacgggttctcacggaactttttcatcatagcctcgatctcctccgctccactcttgcctttcttcacgacagagatacctttctccttagagaagccgtattccacgtaaatcttctgaagcaattgatacaaactcaaaccttgatcttttgcccaagctgcgatctcggctaagataacgcaagcggaaacagcgtctttatcgcgaacgaagtcctcgcaaaggaatccgtagctttcctcgccaccaccgatatagtttttcttgccttcgttctcacgcataacgttagcgatccatttgaagcctgtataaacatcgtacatttctacgccattacgctcggcgatcgtcttgatcgtctctgtcgtaacgattgtctttacgatatattctttaccattgatcttacctaactctttccagcgagtgattaaatagtaaacgaacatcaaagcggtttggttaccattcaaaagtacccattcgccttcgttattcttaacggcggcacctacacggtctgcgtccggatcggaagccattaccaattcagcgtcagtctcttttgctttctctacagccatagctaaagcagccggctcttccgggttcggagagataaccgtcgggaaatcaccgctaacaacatcttgttccggtacatggataatgttcgtgaatccgtaagctttcaaagcggcaggaaccaatttaacacctgttccgtgaattggagtatacacgatcttcatatccttatggcgggaaatagcctccggagacaaagaaatcgttgttaattccttgatatattcatcatcgatcgcttgtccgatgatctcgatcaattctttatttcctttgaatttaatctcgctagcgttacggatcttgttaacctcggcgatcgtattcttatcgtgcggggcgatcatttgtgcgccatcatcccaataagccttgtatccgttgtattctttcggattgtgagaagccgtcaagatgataccgctctggcatcccagtttacggatagcgaatgacatttccggagtcggacgtaggtcttcgaataaataaaccttgatgccgttagcggagaagatatcggctgatatttccgcgaacttacggctgttgttacggcaatcgtggccgatgacaacctttatctgttctaaatccgcaaattcctttttcagatagttggataaaccttgggtagctgcgccaactgtatatatattcatacgatttgaacctacccccatgattccgcgcaatccacctgttccgaattctaggtctttataaaaacactcgattaactcagtaggatcttcgttgtcaagtaacgcttgaacttgagcacgagtttccgcatcataacttttcgtaagccatccttgtgccttacttcttaccatttctaataagtcgttgttttccatgtttataatattattgtgtttattgttgagcaatctactcaatacgataaatatacaagaaacaaatatacgaatttcttaaagtaaagcaatcaaaggacttatattttgcctaaaaaatacgataaatcgtcctaccaagtaaacggatgtgtataaatcgactcatttccgcaagcatccgttacgattaatttaagttcatgcttgcctctttgcaacctctctttatcgaagcgataggtaataaccgatttattattcatctcgaataagacaaactgcccgtctatttctccccggtaggtttgtaccccgcttaagttatcggacaaacggaatatgaagttctgtttgctgacccacgtctgttggttgatcggcgtgataaccggagcctttgtatcttgttgtatcttataactgcccaattccttgatatttgcgtcgatccagccattacggtatgtaccgcccatccaagaggcacgtccgttttgtaagcgaaccacaccatattgttgtttattctcaagcgtatcgctttgcaagaatagtgataactgggccgttccatgcaaaggaattggcttatcgtgcaatatgtgggtggctgataatgaggtactatcttctttcaccgaatagcggaagtagaggtcattatatagattacctttaggcatgacgagacggatgcctttagcgccgaacctattctcgctaccccaatggaataattctgtatgagtcgtatcgatctgggggatctcttgtttctttccctcgatccagatggataaacgggtggcattgccgaaagcgtcagcaagtgtatacgtcaaatgataggtacgaggttcatctatacgcaagattccccggtttacgctttcaaggaagcgtagacggtttcccggctcgatgaaactacgcatatagaaagagcgatgatctttccattcttcgtaatctgtgaatgtgttcagataacgggtctcgtcaaatgcgaacttatcaagattactatggaaaatcacttggctgtctgccgtgagcgtgatttctcgtacgccataaatgttagtcgtattatccatataatcataggcttttacagcgagccctatttctccccatgcctcgatttttccagtgattgtctgtttcccgtttttcgccgtgacgggttttatctcaagcttcttgcttttgccgtttactacgccttttccttcgatggggacgatctgtattccttggattttaggaggacgggtatcggttatccgatccgagaaataatccaaggggtccatgacttcctcggtctcggtgtctcgtacctcaaaatggagatgaggtccaccagagcttccggtattgccgcttaacgctacgacttcatttttctcgacaggaagcaaatccggcgtaaggaagagatttacattgaaactttcttgtgcgtattgttgctcttttacataattcgctattttcttcgagaatttttgtagatggccgtatacggtggtcgttccatccgggtgtgtgatgtaaagcccgttaccgtagccccatggacttacggatatacgtgatacgtatccttcttgtaccgtatgtacgggtttaccttctaccccttgtgtcttgaagtctattccggaatggaaatgattgcttcttaactcaccgaagttcccgctcagtaagatcgggaaatcgaaaggattcctaagttgctgggcgtttgtgttgattatgtgggagccgatgattgcgaatagaccggctagatatatggatctaatattcataggtattacgtattttgacagacaaagataatcgttttcgatgaattatctatctcttatcctttggtatcggacttgtacctgatttcatggggcgagcctttcttttttccaatggccgtccggttgaagggtatatactatgcgatcatgaagccggttgggcctaccttgccagaactcgatacgttcgggaatgacggcatacccgccccagtgagccggacgctccacttcttttccaatccaacgagctgcctctctaatgaaagctcgtataagttgcatacggctgccgatgggttgactttgtggggatatacgagctccgatccggcttttatacgggcgttttttgaaatattgatccgattcatccggggggactttttcagccgtaccttcgatatgtacctgcctttctaattgatgccatacaaacgaaagagagattgccgggttttgtgccagttgcctgccttttcggctttcgtagttggagtagaaaataaacttatcatcatgcaggtcctttaataagacggtacgggtggaaggtttgccttctggagatacggtccctactagcatggccgtgggttcatctactttgctgtctatagcctcttgtaaccattgactgaaaagcaagaatgggttatccggaagttcgctttcccttaatcctccttttgtgtattcttgccggattgaggcgagatttatttccatatgtgttctgtttgcttgttgactacatagcttttcttctttaataggataacaagagatcggaaaaaaggtttcaaggttttcttttcagcgtttgatctgagaacgtattagaaaatcgactgttaatggtaaatggtcactaaaaccgccctcatatttaaagccgtaataggttcgaaaaggacgtaccccccgccatgttttatccttagtcaataaaaaatcaggagcgaatatgtggatgctttccggaatgatatgcatggaagactcttgcgtgatgagatcccggtttacgattatttgatcgagttggctccattcgccttggtatttatgactacccgggaattgagttatatgggggcttgcgaacaaattataataggtacaagatgtggaatctgtgatctgcgtattttcaggaaaggcttgggcagcgaatatctcggaaatacttctgtcttgaggggtatcattgaagtctcccataatgagtatctgcggcttttctcgtatcagtaacagggaatcgctagatccccgtaaagtgcgggccgcgtcaaaacgatccttttcactttctttttctcctccgtagcgggaggggaaatgacacacgaaaacatctaaggtatcgcctgttatgatctttccatatacgtgtaggatatctcgggttaatttgtgtttgttcccggaaaaacgaattggaatggattcatgtcgtaaataaaagaattgatctcgttgataaagaagagcgacattaatacctctgggatcggggctttgagtgataatatatcggtaatcctgccagcggagcggtgtgcgacgggtaagatgagacaggacggagtcattctcgacttcgcaaagagctattaaggccggtgtgctccattccccggcagcgcttattactttcgctatttgttgtagcttatgatagtagcggctttgtgtccagtaccggttgccggaaggtagaaattcatcgtcattcttggttggattatcccttgtgtcgaaaaagttctccacattataggtcatgactttgaacgtagcttgggcaaataacggaggggaggcaaagaataaaagaaaaaacataaaaatcttcatagttaaagctttgattaattgttaatatgtaatgtattcttattcgtttgaatcttcggtctcttcctgaacaaactcgtaggctcctatggtcgggccgttcgaactggttagccggttgacaccgtaacgatcgatcggataattcttcgttatctcgggatctgcttttccgactccggtagtcgatacggaatctggccggaaatcataggtgtatttattttgcttgcctcctactttccgataggaaggagtctttttgataaacaagacctccttgaagtgatcgctggaggattctttggctttaagcgcacagtgattgaaccgataatcgaaatctgtactgccatctgcttttaattcgacatcgtaacttccatcgatagtgcaattgtcaaaataagcttgcgtgataggatacgggccatttccgtctactgttacgttattgagcaagtacaggcatttactatccaaaggaacagtctcgctggccatttcccttttggttaaactcatgtaattagccatcgtacagtgagcgaagtaatatttaccaccgactaaagtgagtacacttcctccggcattgctgaattccgtatttgtagcgataacatcacaattgatggcgaagaatagatcgctccccatattcgtgatctgtgagttgtttatcttgatctttggccggtccggggtggaaggctcgcaatatacaccggaggtaccattacgtacgattacattatcccagacattcccgtagctatccgccttaaaggtaatgcctccccattgtccgggagtccggtcatacggtaatatatcatttagtatataatccaaacggtcgcctcggaaagtgataggctcatccaaggtgcctaaagcgttcatggagccgtgaacgatcaggctcgctttatcatgcatatagaaagtagcccccttctcgatattcaatgaaacccctttagcgataaccaaactatcgtagatcaaataaggacgattggccgtgaggatagaatcttttgtaatcgtaacaccgcctttgtaaagattaacatcctgcccataggcttccaataatacggattgacggatgccattcacggtgaaaagtacggaatcctgtatcaacagaggttgattgcccccattcggatcgaccgttacttccacgaatacatacatgctgtcgttggcgagtattcctacattattaaatgagctacctttgcgtccatccacattcatgcggaagccggtagactctccactggccagcatgatggactcaatgctcagaggttcactatttttattgtagatcataaattgacgggtggtagaaccgatcgtactgaagatcgtgtcaaaagcgagcgtgtctgtcgagaagcttagccggtaagtcgggttagtggaataatgatcatccaaaccgtcgcatgccggaagcatgttcaacagaagcgtcgcgagtataaatagcgttatcgttaatcttttcattttcgtaaatgttaactgtaaatatcttgtgttcttgtttcaatagataaacaaaattatcataaaaaagttgcaagacattaacataaaaaaagaggatagacacggttatcgtgtctttcctctttttataacgcaaaaaacgttggtttattttgcggggatgctctttaataattcaagaaggtggctccaccataaaccgaccgtagcgatctcgatacgctcgttgggtgaatgtacgtcacgcaaagtaggcccgaaagagatcatatccagtttcggatatttttccaagaacaaaccgcactctaatccggcgtggatggccatgatcttggcgtctttgttgaataggcgtttgtaagtctcctgtgcaatcttcaagatcttagagtcggggttcggggcccatcccggatagccgtcgccatgttttacatctgctccagccaataggaacgtggaggctaccgtattggcgatagcgatcttgcatgattcgatagagctacgctggctggtaccgatcaagatcgtattgccttctttcatctttatggaagcaaggttggtagaagtctctaccaagccttctatatcgtggctcataccgattacgccgtgcggacaagcgtgtaaggcgtagattaatttctcggcggtggcattgtctatatggtactccggacgatccgtggactccatcgctaactgaacgttcggatctacatgtttcaactcattttcaacgtcggcggcgaaatggttcagcaagatacgtacatcctccttattttccggatgcaagccgattacggcgtgtgcctcgcgagcgattgcgttacgtaagtttcctccatcgatagagcaaagaacgaaatcatatttctttttcaataagaataagaaacgaaccaagatcttgttggcattgcctaatcctttgtggatctcgccaccggagtgaccgccattcagccctttcacgtcgatacggaaatactgcatcttatcggacgtaggaactggctcgtaatggaaagtcgcttgtgtgtctttacctccggcgcaacccataaagatctctccctcgtcctcgctatcgagatttaacaagatatctccggtcatgaaaccttctttcaaggctttcgctccagtcaaacctgtttcttcgtctaccgtgaacaaacattcgatcggaccgtgttggatatcatcggaggcaagcaaagccaactcggccgctacaccgataccattatcggctcccaaagtagtgccgttggcacgcagccattcgccgtcgacgatcgtctcgatcggatcattgtcgaaatcgtgtttcgtaccgttatttttctcgcaaaccatatccatgtgagactgcaatacgactaccggacgatcctccattcccggagtggcaggctttgacattaaaaggttgccggcttcatctttcttgatagctattttgtactctttcgcgaatgattctaggaattcaatcattttgccttccttttttgaggggcgaggcacttgggttacttgatggaagaacttccatacgatagtaggctttaaatcagtaatcttcataatgttacaatgtattatagatgttactctaaagttaataaaaccgcaactgaaagagcttagttcgaaaaaaagtagaataaaatgccaaaaagacacttagtaatcacttaaactcttatatttgcgtccacaaatatagagaaaatgcttacaacgttattatttacggtcataattcttgttatcagcgtcgtgttgctatcgataaaagtgctgttgaaaaagggaggaaggttcccgaatacgcatatcgaaggaaacagggcgttgggtaagaaaggtatattttgtgcgaagaccatggatcgtatggcggtgaagcaaaagggactctatgacatcatgaacgaaataaaagaataaaaaaataagatttaaattgcactttatgaagaacattaactacgttattaacggtgtgctagcggtggctgtcgtaatcttgtatattatgcaattttccggcaagaaagaatcaagcgtaacaagaacattcgcgtcagcgggagacacaacggccttacttccgatcgcttatgtaaatgtggattccctgttacttaattacaattattccaaggatctgaacgagatcatcttgaagaaacaagagaattcccgtgctaacatcacccagaaagcccgtagtttacaaggcgagatgcaagatttccagcgtaaggtagaaaataacgctttccttacccgtgagagggcggagcaagagcaacaacgtttattgaataagcaacaagagttgcagaacttagataaccaattggctcaagagttgatgcaagagcagcagaagttgaacgagcaattacgcgatacggttgtttctcaattgaaggctttcaatctgggtagaggctatcaagtggtattcagcaatacggtaggagataatatccttttggctggcgattcctatgatatcacaggcgaattgctggaatacttgaataagaattattcctctccggccaagtaagctattaatagaatttataaaagaaagggtgtatcaaaggaacgtttgatacaccctttttttaacggtgcttaccggggactttatagaagatatactgtatctgcaaagtaatatatactgcgttggcctggtcagtatatattcatcggtcgggtcagtagcactgcgttttgcggccaattactctttaggagtaacgaaagcggtatatatctgtaagatagcggctacgctcaagcaaaggatccactcggtacggttgttgaacataaagccggaagatacgatcattagaagtccggcgaatacgttgaaacggtggagccggcggcgacgaaagtccaagtccttaaccggaagggtcagatagcaaacggctatacccgccgcaccgacagcgaataaataaggggcgacagcccaatgagtaagaaacaatatggcaccggctaatacgagtaatcccgctacgccgaaaataatcgatctgatttgttgattcatttatttgtccttgataataaaaacatcctcgttcgaccttttcatgaaatactcttcacgggcgaaacgttccagtccctccttgtccgtatgaaggtcgtttaatttcttgctgttgatctcgatctccttttggtaatgtttgatctctttctccaaaccgcgtattttctcgtcgtacgtatagcgtttatacaggctgctatcgcccaccgtaaaggtgacgataaggaacacgatggtaaccaaccaataagcgttgatccacgatagatactttatgtaaaactcttttatgcgtgacatcagaacatcgttttcgcgaagataatgaattattttgtttatctttgtcttatcaataaaaagcagagaatggataattatattgtatcggcaagaaaatatcgcccgtccactttccggagtgtagtagggcagaagtctcttaccactacgctgaaaaacgcgatacaaagtaacaaattagcgcatgcttacctgttttgcggtcctcgtggagtaggaaagacctcgtgtgcccgtatctttgcgaagacgatcaattgcttgaatccgacggcggatggcgaggcttgcaatgcgtgcgagtcgtgccgggctttcaatgagcagcgttcttacaatatccatgaactggatgccgcctcgaataactcggtggacgatatccgtaccttgatcgaccaagtgcgtatcccgcctccaatcggtaaatacaaagtcttcattattgacgaggtccatatgttgacaaccgccgctttcaacgcattcttgaagacattggaggaacctccgcatcatgctctctttatcttggctacgaccgagaagcacaaggtgcttcccacgatcctttcccgttgtcagatctatgatttctcccgtatatccatcgccgacatggtggagcatttgcaatatgtctcttcgcaagagggggtaacagcggaaccggaagccttgaacgtgatcgctcagaaggcggatggaggtatgcgcgacgctttgtctatctttgaccaagtggtaagtttcacgaatggcaatatcacgtatcaagcggttatcgataacttgaacgtgctggattatgagtattattttcgtctgacagatgcgatcttatccggcaatgtgcgggcttctttattgatcttgaatgagatattaggcaaaggattcgacgggcagaatatcataaccggtttggctgggcatttccgggacttattggtatgccgggatgagtccaccttggtgctattcgaggtgggtgcttctatacgtgaacgatataaggagatggcgaaacattgtccggatcaacttctgttcaaggcgatagagctggcgaatacgtgcgatttgaattatcgtgccagccgcaataagcgtcttttattggaattgacgttgattcagctctgtcaattaacacaggtagccgccgacgataaaaaaaaagcgttaattgagccgattgctgggacgaatccgtcttctcaagcggtgaatagcgggaagcctcaacagccgcctcaagctccttcagttacggcagcggccggtgctccacaagttatgagtacgcacatgccgagctcggttcctgcgccacctccgtctacagcgcctaattcggttcgtagaacggctcgtccgatgggaatctccatgaaggagatcggagtggagaagcctaagcaacaaaccgttcaacaagcgacaacgaacgtaaaggaggtagtaactccctttgacaatgattccttggttcgtgaatgggataattacgccgcaacgattgacaagaaagtgtatcttaagaatacgatgatcaattgcaagcctaccttgcaagagaattattatttcgaggtagccgtacataacccggggcagcaagaggaattgatcaataatgcgatccatatcctgccatttctccgccagcatcttactaatagccgtatccagatgcgtgtccggatcgtagagggaaatgagaagcatttggcttatacatccacggagaagctagagttgctgatgaagataaatcctaccttgggtcgtttgagggatgaatttaatttgacgttagattaagtagatatgctaaagatcccaagaagggatctttagtcttattttttattcctttgtctcaagataaaccacttgagtttgcaaatactcctcaagtccatgttttccatccgcgccaccgattccggatttacgccatcctgcatggaagccttgcatagcctcaaaattctcacggttaatataagtctccccgaattttaaggaacgcattaccttgaatgcgttatccaagttttgtgtatatacggaagatgtcaatccatattcgcaatcattcgcccatgcgatagcgtcgttgatatctgaatattcgacaaccggcagtatggggccaaaagtctcttcttgtatgatatccattttctgtgtaacacaatccaaaacggtcggttcgaagaaatatccttttgtaccgatcctatggccaccacacagtagcctagcaccttgttggatcgctctctctacttttttctccatagactccaacgcgctggcttcaataagcggtcccatatccagatccgcgacctcattgggatttcctacttttacctgcttcatgccggcgactagtttttccatgaaggtctcttttatcgctttgtctacataaacccgttcggcacaattacatacctgtccggtattgatcacacgagaggcaataatagacttaacagcaagatcgatatctgcgtccttcatcacgatagccggggctttacctcctaactccagagaaactttcgtgatattaggagcggcagctgccatggtttgttgtccggctctcacgcttcctgtcagactaaccatacctactttcggattcgccgcgagttcatgcccaatcacgctaccccgtccatttaccagattgaaaacgccggcaggcaaacctgcctcctccacgatctgtgcgaatacgtatgcgttctctggcgtaagctggctaggttttatcacgatcgtatttccggtgatcaaggccggagcggctttacgagcgactagaaagaatgggaaattccaaggtaggatacctgtcgttactccaatcggtctcttaaataagaaaatgttttcatgagggcggtcactgggaatgatttccccttcgtaccgacgggcccagcctgccatgtaatccatataatctgcggtaaaaagaacttcaacattggcgagtccttgggttttgcctccttcacggacgatgatgtcggtcagttccttctctctcttacggatgcctgccgctatctttgtcagataagccgccctttctatagagggtgttctttcccattgattctgcgctttctctgcggcatcgattgcttttctggcatcttcaaccgtcccgtcaggcatcagtgaaataacctcttcggtagaaggattcaataccttgatccatttcccagactcattctcaatgaatctgccatctataaacattttcaattctttcatgatactatttttaggttgaataatttgttcttaaaagtacgggaaaggaaggaatggcaatgttttaaaaatgataatagttctatcagaaatgatagtgaatcaagataatagggtagatataggaaaaacagcctcaagaagttgatcttctcaaggctgtttttttatagaatgatcgtttttcgttttagcaggctttgaagctcatgtccaagctcttcacggagtgagtcaaagcccctacggagatgaagtctacgccacattctgcgtaatcacgtaatgtgtcgaacgtgataccgccggaagactctacctcaaaacgtccgttgatgcggcgaaccgcttcttttgtattctcgatattgaaattatccaacatgatacgatcgataccgcctactttcatggcttgttccaactcgtcgaagttacgaacctcgatctcgatctttaggctctttcctttctctttcagatagttttgcgcacgtgtgatcgcttgctcgatgccgccggcgaaatccacatgattatctttcaataagatcatatcgaacaaaccgatgcgatggttcatgccgccaccgatacgtacggcctctttctcgatcatacgcataccgggagttgtcttgcgagtatctagaacgtgtgtcttggtgccttctaacgccttggcgtatttacgagtcgtagtagcgataccgctcatgcgttgcataacgttcagcatcaaccgctcggtctgcaataaggattggatcttaccttccaccacgaacgctatatccccttttttcacttcggctccgtcttgtataaagaccgtcattttcagttccggatcgaagtcgtggaagatacgtttagccatttccacgccggccaatacgccatcttccttgatgatcagctggcttttccccatcgctgtctcggggatgcaacataaggtggtatgatcgccatcgccaatatcctcggcaaacgctaatttgattaagtcgtcaataagtttgtccatcttttattctattctgattgattgtatgatcgctgtattcccttcggcacggtacgtgatgtttacacggtactcaccggaagacgtcggaagctttccgacaaggaaaccgctttcctttttatccgcatgatgtacgaccgagaatccggaaggcttattcgaactgaaaaatgaggacaacatagagacggcctcacttccgttacatttcttagaggaactgggcaaggctacatccaccaccttatccatagcaccggatagagaggaggcatttcctgccttgaaagcatttgatatactggtaatatccgccgcctgcgcacatacgaacgcgaatatcaaggcgaatgtaagtaagagtcgtttcataagctttctttattttattgagtaattagtggcaaaggtatgtatttttcttgtaacttagcctttctaaacatgtaaatgtaagtagatgaagattggactgattgtgattggtaagacggatgccggttattttgtggaggctatcaatgagtataaaaatcgcttgacacattatataccctttgaaatggaagtcataccggatataaagaacgtgaagaatctctctgaggcgcagcaaaaggagaaggagggagaattgattttaaaggccttgcagcccggcgattatttggtgttgctggatgagaaagggaaggagtttacctccatgcaattttctacttatctggaaaagaaaatgcatacggtcccgaaacgcttggtatttgtggtaggcggtccttacggttttagtgaagctgtgtataaggcggcatcggaaaagatctcgttgagcaagatgactttttcccaccagatgatccgactgatctttatcgagcagatttaccgggcaatgacgatcttgaataacgagccttatcatcacgagtagttgcgtcggttaacggcagtataggcgtagccctatacctatactgccgtaagctcacgcctatactggcgtagccttacggcaatactggtgtttttttacccggattaatggactaatttcaacccgacgatccctatcaatatcaaagataagaacaataacctgaatatatttgcggaatcatggaaaaacaagattccaagaagaacagtccctatagccccgatcccggtccagattacataagccgtaccgattgggatgcttttctgggcgagatataagaaatagccgcttaagcccatggataagatcgataaacctataaaccaaataaaatatttggaatgcatacttgctaatttaaagcccagcggccagccgatctcgaataatccggctataattaacagaatccaagccatatagaattagtcttaaaagttttcccgtgtcttttggatcaataaataatccaataaagtcatggcggtcatagactcgacgataggtaccgcacgaggcaatacgcatggatcatgacgtccgcgtgcctttaatatcgtatcctctccctccatattaaccgtttcttgttccatcaagatcgtagcgaccgatttaaaggctacccggaaataaatatcttgtccgttggatatccctccttggataccgccggaattattggtacgagtattgatatgcccgttatcattgaaaaagcgatcgttcctttccgatccgcggaagaaggcggcgttgaatccgtctccatactcgaagcctttcacggcgttgatcgtaagcatcgcatgtcccaacgcggcatgtaacttgccgaacacaggctctcccaatccgacgggaacccctttcgccacacaggtaataacaccgccgatcgtatctccttttgatttgacctcagcgatcaaggtttccatctctgaggcggtcttcgggtccgggcaacgtacatcgctcttttccgtcaagcttaaatcataatcttggtaactacccgctaatttgatcgggccgacctgcgaggtataagcttgaatctgtatgccgtattgcttaagggcgagtttagcgatagccccagccacgcaacgagcgatcgtttcccgggcggacgaacgtccacctccacggggatcacggattccatatttcgtttgataggtataatcagcatgggaaggacggtaaaccgttttcatattgtcatagtcagaggaatgttggtttttgttccagatgatgaaacctatcggcgtaccggttgtctttccctcgtagataccagaaagaaactgtacctcatcatcctctttacggggggtcgtgatacgggattgtcccggtttacgacggttcagctcttgctggatgaatgccgtatctaattcgatcccggctgggcatccgtcgatcacgccgccgataccggggccgtgcgattcgccgaacgatgttaatctataaatattaccaaaagtattcaccgttttgtctaattgaaaattgaaaactgaaaattgagaatcaaaagccgatgattaggcacttctccta

SEQ ID NO: 11 - DNA, 1398 bp, Megasphaera massiliensis
tgagaagcttgcttcttatcgattctagtggcaaacgggtgagtaacgcgtaagcaacctgcccttcagatggggacaacagctggaaacggctgctaataccgaatacgttctttccgccgcatgacgggaagaagaaagggaggccttcgggctttcgctggaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatatgggacgaacaggacatcggttaatacccggtgtctttgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaagctcgagtgtcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggttcttcttcggaagacaagaaaacaggtggtgcacggctgtcgtcagctcgtgtcgtgagatgttgggttaagtcccgcaacgagcgcaacccctatcttctgttgccagcacctcgggtggggactcagaagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggcaaccgcaag

SEQ ID NO: 12 - DNA, 20 bp, Artificial Sequence
  Primer
gatcaagatcattgctcctc

SEQ ID NO: 13 - DNA, 20 bp, Artificial Sequence
  Primer
ttgtcaagaaagggtgtaac

SEQ ID NO: 14 - DNA, 21 bp, Artificial Sequence
  Primer
ggtatcgtggaaggactcatg

SEQ ID NO: 15 - DNA, 21 bp, Artificial Sequence
  Primer
atgccagtgagcttcccgttc

SEQ ID NO: 16 - DNA, 20 bp, Artificial Sequence
  Primer
ctcagcaccgctaacagagg

SEQ ID NO: 17 - DNA, 19 bp, Artificial Sequence
  Primer
cattggcgcttctctcctc

SEQ ID NO: 18 - DNA, 20 bp, Artificial Sequence
  Primer
aagaggaattttgacactgg

SEQ ID NO: 19 - DNA, 20 bp, Artificial Sequence
  Primer
gccatgtactcttcactttc

SEQ ID NO: 20 - DNA, 20 bp, Artificial Sequence
  Primer
aagtcacactggtgaaatcc

SEQ ID NO: 21 - DNA, 20 bp, Artificial Sequence
  Primer
ctcttgctgccaaactatct

SEQ ID NO: 22 - DNA, 19 bp, Artificial Sequence
  Primer
ccctcccctggatcaggat

SEQ ID NO: 23 - DNA, 20 bp, Artificial Sequence
  Primer
gccatcaaactcgtccatca

SEQ ID NO: 24 - DNA, 20 bp, Artificial Sequence
  Primer
cattacctgctctacgtttg

SEQ ID NO: 25 - DNA, 21 bp, Artificial Sequence
  Primer
agatggacataagatgaggtg
